(12) United States Patent
Berka et al.

(10) Patent No.: US 7,387,875 B2
(45) Date of Patent: Jun. 17, 2008

(54) METHODS FOR MONITORING MULTIPLE GENE EXPRESSION

(75) Inventors: Randy Berka, Davis, CA (US); Elena Bachkirova, Davis, CA (US); Michael Rey, Davis, CA (US)

(73) Assignee: Novozymes, Inc., Davis, CA (US)

( * ) Notice: Subject to any disclaimer, the term of this patent is extended or adjusted under 35 U.S.C. 154(b) by 238 days.

(21) Appl. No.: 10/950,009

(22) Filed: Sep. 24, 2004

(65) Prior Publication Data

US 2005/0069934 A1 Mar. 31, 2005

Related U.S. Application Data

(60) Provisional application No. 60/506,140, filed on Sep. 25, 2003.

(51) Int. Cl.
*C12Q 1/68* (2006.01)
*C12N 1/00* (2006.01)
*C07H 21/04* (2006.01)

(52) U.S. Cl. .................. 435/6; 435/254.1; 536/23.1

(58) Field of Classification Search .................. 435/6, 435/287.2
See application file for complete search history.

(56) References Cited

FOREIGN PATENT DOCUMENTS

WO  WO 0049177   8/2000
WO  WO 00/56762  9/2000

OTHER PUBLICATIONS

Schmoll et al. Cloning of genes expressed early during cellulase induction in *Hypocrea jecorina* by a rapid subtraction hybridization approach Fungal Genetics and Biology 41:877-887, 2004.*
Chambergo et al., Elucidation of the Metabolic Fate of Glucose in the Filamentous Fungus *Trichoderma reesei* Using Expressed Sequence Tag (EST) Analysis and cDNA Microarrays, The Journal of Biological Chemistry, 2002, v. 277, No. 16, pp. 13983-13988.
Foreman et al., Transcriptional Regulation of Biomass-degrading Enzymes in the Filamentous Fungus *Trichoderma reesei*, The Journal of Biological Chemistry, 2003, vol. 278, No. 34, pp. 31988-31997.
Nakari-Setala et al., Differential expression of the vegetative and spore-bound hydrophobins of *Trichoderma reesei* Cloning and characterization of the *hfb2* gene, Eur. J. Biochem, 1997, vol. 248, pp. 415-423.
Watson et al., Technology for microarray analysis of gene expression, Current Opinion in Biotechnology 1998, 9: 609-614.
Chu et al., The Transcriptional Program of Sporulation in Budding Yeast, Science, vol. 282, Oct. 23, 1998, pp. 699-705.
Diatchienko et al., Suppression subrractive hybridization: A method for generating differentially regulated or tissue-specific cDNA probes and libraries, Proc. Natl. Acad. Sci. vol. 93, pp. 6025-6030, Jun. 1996.
Ruan et al., Towards *Arabidopsis* genome analysis: monitoring expression profiles of 1400 genes using cDNA microarrays, The Plant Journal, 1998, 15(6), pp. 821-833.
Yang et al., Combing SSH and cDNA microarrays for rapid identification of differentially expressed genes, Nucleic Acids Research, 1999, vol. 27, No. 6, pp. 1517-1523.
Porkka et al., Detection of differentially expressed genes in prostate cancer by combining suppression subtractive hybridization and cDNA library array, Journal of Pathology, 2001, vol. 193, pp. 73-79.
Hayward et al., Shotgun DNA microarrays and stage-specific gene expression in *Plasmodium falciparum* malaria, Molecular Microbiology, 2000, vol. 35(1), pp. 6-14.

* cited by examiner

*Primary Examiner*—Nancy Vogel
(74) *Attorney, Agent, or Firm*—Robert L. Stames

(57) ABSTRACT

The present invention relates to methods for monitoring differential expression of a plurality of genes in a first filamentous fungal cell relative to expression of the same genes in one or more second filamentous fungal cells using microarrays containing *Trichoderma reesei* ESTs or SSH clones, or a combination thereof. The present invention also relates to computer readable media and substrates containing such array features for monitoring expression of a plurality of genes in filamentous fungal cells.

8 Claims, 1 Drawing Sheet

METHODS FOR MONITORING MULTIPLE GENE EXPRESSION

CROSS-REFERENCE TO RELATED APPLICATION

This application claims the benefit of U.S. Provisional Application No. 60/506,140, filed Sep. 25, 2003, which application is incorporated herein by reference.

STATEMENT AS TO RIGHTS TO INVENTIONS MADE UNDER FEDERALLY SPONSORED RESEARCH AND DEVELOPMENT

This invention was made with Government support under NREL Subcontract No. ZCO-30017-02, Prime Contract DE-AC36-98GO10337 awarded by the Department of Energy. The government has certain rights in this invention.

BACKGROUND OF THE INVENTION

1. Field of the Invention

The present invention relates to methods for monitoring expression of a plurality of genes in filamentous fungal cells. The present invention also relates to substrates and computer readable media for monitoring expression of a plurality of genes in filamentous fungal cells.

2. Description of the Related Art

Microarray technology is increasingly becoming the method of choice for the quantitative and simultaneous analysis of the expression levels of many thousands of genes. Microarray analyses typically follow the steps of gene selection, microarray synthesis, sample preparation, array hybridization, detection, and data analysis (Watson et al., 1998, *Current Opinion in Biotechnology* 9: 609-614).

PCR-amplified coding sequences of genomic DNA are particularly useful in microarrays for obtaining global expression profiles where the genome of the organism has been fully sequenced. Chu et al., 1998, *Science* 282: 699-705, disclose the use of microarrays containing PCR-amplified genomic coding sequences for determining the temporal expression of *Saccharomyces cerevisiae* genes during sporulation.

For other organisms whose genomes have not been sequenced, global expression profiles may be obtained with arraying (1) random genomic DNA segments or clones (e.g., from a genomic DNA library); (2) random cDNA clones (e.g., from one or more cDNA libraries) that are uncharacterized at the DNA sequence level; (3) EST clones that have been sequenced and partially characterized with respect to putative identification and function; or (4) cDNA clones that are enriched for differentially expressed sequences (Diatchenko et al., 1996, *Proc Natl. Acad. Sci. USA* 93: 6025-6030).

However, there are disadvantages with using random genomic or cDNA clones from organisms whose genomes have not been fully sequenced. These disadvantages include (1) more than one gene may be represented on a single clone; (2) no gene(s) may be encoded on a single clone; (3) extensive characterization and DNA sequencing is required to follow-up array spots that appear interesting; and (4) duplicity, multiplicity, and redundancy add to the follow-up work.

Expressed sequenced tags (ESTs) are partial cDNA sequences of expressed genes. Simply stated, an EST is a segment of a sequence from a cDNA clone that corresponds to the mRNA of a specific gene. The use of sequenced ESTs in microarrays compared to genomic clones or random cDNA clones provides several advantages especially for organisms whose genomes have not been sequenced. First, redundancy is eliminated because one spot on an array equals one gene or open reading frame. Second, since sequence information is available, redundancy and follow-up characterization is minimized. Third, EST microarrays can be organized based on function of the gene products to facilitate analysis of the results (e.g., ESTs encoding enzymes from the same metabolic pathway can be arranged or grouped accordingly).

Ruan et al., 1998, *The Plant Journal* 15: 821-833, disclose the use of microarrays containing *Arabidopsis thaliana* EST sequences for determining the temporal expression of *Arabidopsis thaliana* genes in root, leaf, and two stages of floral development.

Iyer et al., 1999, *Science* 283; 83-87, disclose the use of microarrays containing human EST sequences for determining the temporal expression of human fibroblast cells in response to serum.

Diatchenko et al., 1996, supra, disclose a method called suppression subtractive hybridization (SSH) for generating differentially regulated or tissue-specific cDNA probes and libraries. Yang et al., 1999, *Nucleic Acids Research* 27: 1517-1523, describe combining SSH and cDNA microarrays for rapid identification of differentially expressed genes. Porkka and Visakorpi, 2001, *Journal of Pathology* 193: 73-79, disclose detection of differentially expressed genes in prostrate cancer by combining SSH and cDNA library arrays.

Hayward et al., 2000, *Molecular Microbiology* 35: 6-14, disclose shotgun DNA microarrays and stage-specific gene expression in *Plasmodium falciparum* malaria.

WO 2000/56762 discloses methods for monitoring differential expression of a plurality of genes in a first filamentous fungal cell relative to expression of the same genes in one or more second filamentous fungal cells using microarrays containing filamentous fungal expressed sequenced tags.

Filamentous fungi are increasingly being used as host microorganisms for the industrial production of enzymes and other proteins whether endogenous or heterogenous to the microorganisms. There is a need in the art to provide methods for monitoring the global expression of genes from filamentous fungal cells to improve the production potential of these microorganisms and to identify new genes whose products have industrial applicability.

It is an object of the present invention to provide alternative methods for monitoring expression of a plurality of genes in filamentous fungal cells.

SUMMARY OF THE INVENTION

The present invention relates to methods for monitoring differential expression of a plurality of genes in a first filamentous fungal cell relative to expression of the same genes in one or more second filamentous fungal cells, comprising:

(a) adding a mixture of detection reporter-labeled nucleic acids isolated from the filamentous fungal cells to a substrate containing an array of *Trichoderma reesei* ESTs or SSH clones, or a combination thereof, selected from the group consisting of SEQ ID NOs. 1-1188, nucleic acid fragments of SEQ ID NOs. 1-1188, and nucleic acid sequences having at least 90% homology to SEQ ID NOs. 1-1188, under conditions where the nucleic acids hybridize to complementary sequences of the ESTs or SSH clones, or a combination thereof, in the array, wherein the nucleic acids from the first filamentous fungal cell and the one or more second filamentous fungal cells are labeled with a first detection reporter and one or more different second detection reporters, respectively; and (b) examining the array under conditions wherein the relative expression of the genes in the filamentous fungal cells is determined by the observed detection signal of each spot in the array in which (i) the *Trichoderma reesei* ESTs or SSH clones, or a combination thereof, in the array that hybridize to the nucleic acids obtained from either the first or the one or more second filamentous fungal cells produce a distinct first detection signal or one or more second detection signals, respectively, and (ii) the *Trichoderma reesei* ESTs or SSH clones, or a combination thereof, in the array that hybridize to the nucleic acids obtained from both the first and one or more second filamentous fungal cells produce a distinct combined detection signal.

The present invention also relates to computer readable media and substrates containing an array of such *Trichoderma reesei* ESTs or SSH clones, or a combination thereof, for monitoring differential expression of a plurality of genes in a first filamentous fungal cell relative to expression of the same genes in one or more second filamentous fungal cells.

DETAILED DESCRIPTION OF THE INVENTION

Figure 1:
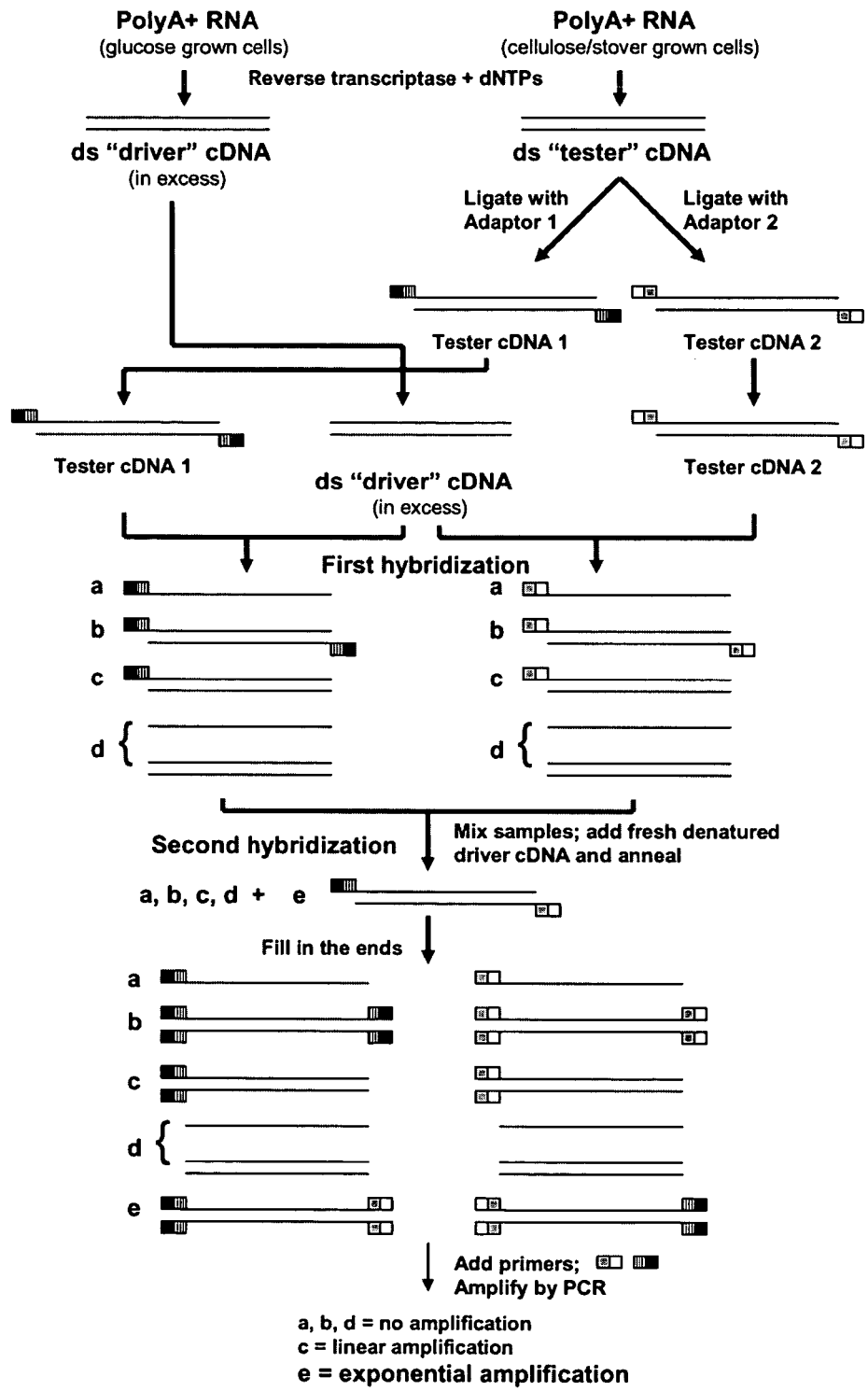
FIG. 1 show the SSH method for generation of subtractive and normalized cDNA libraries.

The present invention relates to methods for monitoring differential expression of a plurality of genes in a first filamentous fungal cell relative to expression of the same genes in one or more second filamentous fungal cells. The methods comprise (a) adding a mixture of detection reporter-labeled nucleic acids isolated from the two or more filamentous fungal cells with different detection reporters for each cell's nucleic acids to a substrate containing an array of *Trichoderma reesei* ESTs or SSH clones, or a combination thereof, under conditions where the nucleic acids hybridize to complementary sequences of the ESTs or SSH clones, or a combination thereof, in the array; and (b) examining the array under conditions wherein the relative expression of the genes in the two or more cells is determined by the observed detection signal of each spot in the array.

The methods of the present invention may be used to monitor global expression of a plurality of genes from a filamentous fungal cell, discover new genes, identify possible functions of unknown open reading frames, and monitor gene copy number variation and stability. For example, the global view of changes in expression of genes may be used to provide a picture of the way in which filamentous fungal cells adapt to changes in culture conditions, environmental stress, or other physiological provocation. Other possibilities for monitoring global expression include spore morphogenesis, recombination, metabolic or catabolic pathway engineering. In a preferred embodiment, the methods of the present invention are used to identify microbial genes induced when the microorganism is grown on cellulose or corn stover. In more preferred embodiment, the microorganism is a *Trichoderma* strain. In a most preferred embodiment, the microorganism is a *Trichoderma reesei* strain.

The methods of the present invention are particularly advantageous because one spot on an array equals one gene or open reading frame, extensive follow-up characterization is unnecessary since sequence information is available, and EST and/or SSH microarrays can be organized based on function of the gene products.

Expressed Sequenced Tags and Suppression Subtractive Hybridization (SSH) Clones

The term "array features" is defined herein as array elements of ESTs or SSH clones, or a combination thereof.

The term "expressed sequenced tag" or "EST" is defined herein as a segment of a sequence from a cDNA clone of an expressed *Trichoderma reesei* gene. The term "EST" will be understood to also include two or more ESTs assembled into a contig. In the methods of the present invention, the *Trichoderma reesei* ESTs described herein preferably represent a plurality of genes or homologues thereof present in the two or more filamentous fungal cells to be evaluated.

ESTs are generally generated as follows: Total polyadenylated mRNA is isolated from a filamentous fungal cell and reverse transcribed into total cDNA. The total cDNA is digested with a restriction endonuclease, size-selected by agarose gel electrophoresis, isolated, and ligated into a vector, e.g., pZErO-2.1. The ligation mixture is transformed into competent *E. coli* cells and transformants are selected under selective pressure, e.g., kanamycin selection. The cDNA clones isolated from the selected transformants are amplified, isolated, and partially sequenced. The partial sequences are then compared to sequences in various publicly available databases for identification.

Any method known in the art may be used for generating ESTs (see, for example, Adams et al., 1991, *Science* 252: 1651-1656; Fields, 1996, *Tibtech* 14: 286-289; Weinstock et al., 1994, *Current Opinion in Biotechnology* 5: 599-603; Matsubara and Okubo, 1993, *Current Opinions in Biotechnology* 4: 672-677; Nelson et al., 1997, *Fungal Genet. Biol.* 21: 348-363; Zhu at al., *Genetics* 157: 1057-1065).

In a preferred embodiment, the ESTs are SEQ ID NOs: 1-24.

The term "SSH clones" is defined herein as selectively amplified target cDNA fragments which are differentially expressed. SSH is used to selectively amplify these target cDNA fragments and simultaneously suppress nontarget DNA amplification.

Any method known in the art may be used for generating SSH clones (see, for example, Diatchenko et al., 1996, supra, Yang et al., 1999, supra; Porkka and Visakorpi, 2001, supra).

In a preferred embodiment, the SSH clones are SEQ ID NOs: 25-65.

In the methods of the present invention, the *Trichoderma reesei* array features are preferably at least about 50 bp in length, more preferably at least about 100 bp in length, even more preferably at least about 150 bp in length, and most preferably at least about 200 bp in length. Furthermore, the array features are preferably directional ESTs or SSH clones, or a combination thereof. However, nondirectional ESTs or SSH clones, or a combination thereof, may also be used. A "directional EST" is defined as a cDNA cloned in the same orientation relative to the vector cloning sites, e.g., 5'→3' or 3'→5'.

In a preferred embodiment, the array features are obtained from *Trichoderma reesei*. In a more preferred embodiment, the array features are obtained from *Trichoderma reesei* strain RutC30 (Montenecourt and Eveleigh, 1979, *Adv. Chem. Ser.* 181: 289-301). In a most preferred embodiment, the *Trichoderma reesei* array features are selected from the group consisting of SEQ ID NOs. 1-1188, nucleic acid fragments of SEQ ID NOs. 1-1188, or nucleic acid sequences having at least 95%, preferably at least 99% and most preferably at least 99.9% homology to a sequence of SEQ ID NOs. 1-1188.

In another preferred embodiment, the array features obtained from *Trichoderma reesei* are ESTs. In another preferred embodiment, the array features obtained from *Trichoderma reesei* are SSH clones. In another preferred embodiment, the array features obtained from *Trichoderma reesei* are a combination of two or more of ESTs and SSH clones.

For purposes of the present invention, the degree of homology between two nucleic acid sequences is determined by the Wilbur-Lipman method (Wilbur and Lipman, 1983, *Proceedings of the National Academy of Science USA* 80: 726-730) using the LASERGENE™ MEGALIGN™ software (DNASTAR, Inc., Madison, Wis.) with an identity table and the following multiple alignment parameters: Gap penalty of 10 and gap length penalty of 10. Pairwise alignment parameters are Ktuple=3, gap penalty=3, and windows=20.

Microarrays

The term "an array of *Trichoderma reesei* ESTs or SSH clones, or a combination thereof" is defined herein as a linear or two-dimensional array of preferably discrete array features, each having a finite area, formed on the surface of a solid support.

The term "microarray" is defined herein as an array of features (i.e., ESTs or SSH clones, or a combination thereof) having a density of discrete array elements of at least about $100/cm^2$, and preferably at least about $1000/cm^2$. The printed elements in a microarray have typical dimensions, e.g., diameters, in the range of between about 10 to about 250 µm, preferably in the range of between about 10 to about 200 µm, more preferably in the range of between about 20 to about 150 µm, even more preferably in the range of between about 20 to about 100 µm, most preferably in the range of between about 20 to about 75 µm, and even most preferably in the range of between about 25 to about 50 µm, and are separated from other printed elements in the microarray by about the same distance.

Methods and instruments for forming microarrays on the surface of a solid support are well known in the art. See, for example, U.S. Pat. No. 5,807,522; U.S. Pat. No. 5,700,637; and U.S. Pat. No. 5,770,151. The instrument may be an automated device such as described in U.S. Pat. No. 5,807,522.

The term "a substrate containing an array of *Trichoderma reesei* ESTs or SSH clones, or a combination thereof," is defined herein as a solid support having deposited on the surface of the support one or more of a plurality of array features, for use in detecting binding of labeled cDNAs to the array features.

The substrate may, in one aspect, be a glass support (eg., glass slide) having a hydrophilic or hydrophobic coating on the surface of the support, and an array of distinct array features electrostatically bound non-covalently to the coating, where each distinct array features is disposed at a separate, defined position.

Each microarray in the substrate preferably contains at least $10^3$ distinct array features in a surface area of less than about 1 $cm^2$. Each distinct array feature (i) is disposed at a separate, defined position in the array, (ii) has a length of at least 50 bp, and (iii) is present in a defined amount between about 0.1 femtomoles and 100 nanomoles or higher if necessary.

For a hydrophilic coating, the glass slide is coated by placing a film of a polycationic polymer with a uniform thickness on the surface of the slide and drying the film to form a dried coating. The amount of polycationic polymer added should be sufficient to form at least a monolayer of polymers on the glass surface. The polymer film is bound to the surface via electrostatic binding between negative silyl-OH groups on the surface and charged cationic groups in the polymers. Such polycationic polymers include, but are not limited to, polylysine and polyarginine.

Another coating strategy employs reactive aldehydes to couple DNA to the slides (Schena et al., 1996, *Proceedings of the National Academy of Science USA* 93: 10614-10619; Heller at al., 1997, *Proceedings of the National Academy of Science USA* 94: 2150-2155).

Alternatively, the surface may have a relatively hydrophobic character, i.e., one that causes aqueous medium deposited on the surface to bead. A variety of known hydrophobic polymers, such as polystyrene, polypropylene, or polyethylene, have desirable hydrophobic properties, as do glass and a variety of lubricant or other hydrophobic films that may be applied to the support surface. A support surface is "hydrophobic" if an aqueous droplet applied to the surface does not spread out substantially beyond the area size of the applied droplet, wherein the surface acts to prevent spreading of the droplet applied to the surface by hydrophobic interaction with the droplet.

In another aspect, the substrate may be a multi-cell substrate where each cell contains a microarray of array features, and preferably an identical microarray, formed on a porous surface. For example, a 96-cell array may typically have array dimensions between about 12 and 244 mm in width and 8 and 400 mm in length, with the cells in the array having width and length dimension of ⅟₁₂ and ⅛ the array width and length dimensions, respectively, i.e., between about 1 and 20 in width and 1 and 50 mm in length.

The solid support may include a water-impermeable backing such as a glass slide or rigid polymer sheet, or other non-porous material. Formed on the surface of the backing is a water-permeable film which is made of porous material. Such porous materials include, but are not limited to, nitrocellulose membrane nylon, polypropylene, and PVDF polymer. The thickness of the film is preferably between about 10 and 1000 µm. The film may be applied to the backing by spraying or coating, or by applying a preformed membrane to the backing.

The film surface may be partitioned into a desirable array of cells by water-impermeable grid lines typically at a distance of about 100 to 2000 µm above the film surface. The grid lines can be formed on the surface of the film by laying down an uncured flowable resin or elastomer solution in an array grid, allowing the material to infiltrate the porous film down to the backing, and then curing the grid lines to form the cell-array substrate.

The barrier material of the grid lines may be a flowable silicone, wax-based material, thermoset material (e.g., epoxy), or any other useful material. The grid lines may be applied to the solid support using a narrow syringe, printing techniques, heat-seal stamping, or any other useful method known in the art.

Each well preferably contains a microarray of distinct array features. "Distinct array features" as applied to the ESTs or SSH clones, or a combination thereof, forming a microarray is defined herein as an array feature which is distinct from other array features on the basis of a different nucleic add sequence, and/or different concentrations of the same or distinct array features, and/or different mixtures of distinct array features or different-concentrations of array features. Thus an array of "distinct array features" may be an array containing, as its components, (i) distinct array features, which may have a defined amount in each component, (ii) different, graded concentrations of given-sequence array features, and/or (iii) different-composition mixtures of two or more distinct array features.

However, any type of substrate known in the art may be used in the methods of the present invention.

The delivery of a known amount of a selected EST or SSH clone to a specific position on the support surface is preferably performed with a dispensing device equipped with one or more tips for insuring reproducible deposition and location of the array features and for preparing multiple arrays. Any dispensing device known in the art may be used in the methods of the present invention. See, for example, U.S. Pat. No. 5,807,522. The dispensing device preferably contains a plurality of tips.

For liquid-dispensing on a hydrophilic surface, the liquid will have less of a tendency to bead, and the dispensed volume will be more sensitive to the total dwell time of the dispenser tip in the immediate vicinity of the support surface.

For liquid-dispensing on a hydrophobic surface, flow of fluid from the tip onto the support surface will continue from the dispenser onto the support surface until it forms a liquid bead. At a given bead size, i.e., volume, the tendency of liquid to flow onto the surface will be balanced by the hydrophobic surface interaction of the bead with the support surface, which acts to limit the total bead area on the surface, and by the surface tension of the droplet, which tends toward a given bead curvature. At this point, a given bead volume will have formed, and continued contact of the dispenser tip with the bead, as the dispenser tip is being withdrawn, will have little or no effect on bead volume.

The desired deposition volume, i.e., bead volume, formed is preferably in the range 2 µl (picoliters) to 2 nl (nanoliters), although volumes as high as 100 nl or more may be dispensed. It will be appreciated that the selected dispensed volume will depend on (i) the "footprint" of the dispenser tip(s), i.e., the size of the area spanned by the tip(s), (ii) the hydrophobicity of the support surface, and (iii) the time of contact with and rate of withdrawal of the tip(s) from the support surface. In addition, bead size may be reduced by increasing the viscosity of the medium, effectively reducing the flow time of liquid from the dispensing device onto the support surface. The drop size may be further constrained by depositing the drop in a hydrophilic region surrounded by a hydrophobic grid pattern on the support surface.

At a given tip size, bead volume can be reduced in a controlled fashion by increasing surface hydrophobicity, reducing time of contact of the tip with the surface, increasing rate of movement of the tip away from the surface, and/or increasing the viscosity of the medium. Once these parameters are fixed, a selected deposition volume in the desired pl to nl range can be achieved in a repeatable fashion.

After depositing a liquid droplet of an array feature sample at one selected location on a support, the tip may be moved to a corresponding position on a second support, the sample is deposited at that position, and this process is repeated until the sample has been deposited at a selected position on a plurality of supports.

This deposition process may then be repeated with another EST or SSH clone sample at another microarray position on each of the supports.

The diameter of each array feature region is preferably between about 20-200 µm. The spacing between each region and its closest (non-diagonal) neighbor, measured from center-to-center, is preferably in the range of about 20-400 µm. Thus, for example, an array having a center-to-center spacing of about 250 µm contains about 40 regions/cm$^2$ or 1,600 regions/cm$^2$. After formation of the array, the support is treated to evaporate the liquid of the droplet forming each region, to leave a desired array of dried, relatively flat array feature regions. This drying may be done by heating or under vacuum.

Filamentous Fungal Cells

In the methods of the present invention, the two or more filamentous fungal cells may be any filamentous fungal cell where one of the cells is used as a reference for identifying differences in expression of the same or similar complement of genes in the other cell. In one aspect, the two or more cells are the same cell. For example, they may be compared under different growth conditions, e.g., carbon source, oxygen limitation, nutrition, and/or physiology. In another aspect, one or more cells are mutants of the reference cell. For example, the mutant(s) may have a different phenotype. In a further aspect, the two or more cells are of different species (e.g., *Trichoderma reesei* and *Trichoderma viride*). In another further aspect, the two or more cells are of different genera. In an even further aspect, one or more cells are transformants of the reference cell, wherein the one or more transformants exhibit a different property. For example, the transformants may have a different or improved phenotype relative to the reference cell and/or one of the other transformants. The term "phenotype" is defined herein as an observable or outward characteristic of a cell determined by its genotype and modulated by its environment. Such different or improved phenotypes may include, but are not limited to, improved secretion or production of a protein or compound, reduced or no secretion or production of a protein or compound, improved or reduced expression of a gene, desirable morphology, an altered growth rate under desired conditions, relief of over-expression mediated growth inhibition, or tolerance to low oxygen conditions, improved filterability or flocculation properties, or altered protein glycosylation.

In a preferred embodiment, the differential expression of a plurality of genes in a first filamentous fungal cell relative to expression of the same genes in one or more second filamentous fungal cells is a result of growth of the first filamentous fungal cell on glucose and growth of the one or more second filamentous fungal cells on cellulose, hemicellulose, and/or corn stover to identify genes that are induced by growth on cellulose, hemicellulose, or corn stover. The corn stover is preferably pre-treated and washed corn stover as described herein.

The filamentous fungal cells may be any filamentous fungal cells, but preferably *Acremonium, Aspergillus, Aureobasidium, Bjerkandera, Ceriporiopsis, Coprinus, Coriolus, Cryptococcus, Filibasidium, Fusarium, Humicola, Magnaporthe, Mucor, Myceliophthora, Neocallimastix, Neurospora, Paecilomyces, Penicillium, Phanerochaete, Phlebia, Piromyces, Pleurotus, Schizophyllum, Talaromyces, Thermoascus, Thielavia, Tolypocladium, Trametes,* or *Trichoderma* cells, and more preferably *Aspergillus awamori, Aspergillus fumigatus, Aspergillus foetidus, Aspergillus japonicus, Aspergillus nidulans, Aspergillus niger, Aspergillus oryzae, Bjerkandera adusta, Ceriporiopsis aneirina, Ceriporiopsis aneirina, Ceriporlopsis caregiea, Ceriporiopsis gilvescens, Ceriporiopsis pannocinta, Ceriporiopsis*

*rivulosa, Ceriporiopsis subrufa, Ceriporiopsis subvermispora, Coprinus cinereus, Coriolus hirsutus, Fusarium bactridioides, Fusarium cerealis, Fusarium crookwellense, Fusarium culmorum, Fusarium graminearum, Fusarium graminum, Fusarium heterosporum, Fusarium negundi, Fusarium oxysporum, Fusarium reticulatum, Fusarium roseum, Fusarium sambucinum, Fusarium sarcochroum, Fusarium sporotrichioides, Fusarium sulphureum, Fusarium torulosum, Fusarium trichothecioides, Fusarium venenatum, Humicola insolens, Humicola lanuginosa, Mucor miehei, Myceliophthora thermophila, Neurospora crassa, Penicillium purpurogenum, Phanerochaete chrysosporium, Phlebia radiata, Pleurotus eryngii, Thielavia terrestris, Trametes villosa, Trametes versicolor, Trichoderma harzianum, Trichoderma koningii, Trichoderma longibrachiatum, Trichoderma reesei,* or *Trichoderma viride* cells.

In a preferred embodiment, the filamentous fungal cells are *Trichoderma* cells. In a more preferred embodiment, the *Trichoderma* cells are *Trichoderma reesei* cells. In a most preferred embodiment, the *Trichoderma* cells are *Trichoderma reesei* strain RutC30 (Montenecourt and Eveleigh, 1979, supra).

In the methods of the present invention, the cells are cultivated in a nutrient medium suitable for growth using methods well known in the art for isolation of the nucleic acids to be used as probes. For example, the cells may be cultivated by shake flask cultivation, small-scale or large-scale fermentation (including continuous, batch, fed-batch, or solid state fermentations) in laboratory or industrial fermentors performed in a suitable medium. The cultivation takes place in a suitable nutrient medium comprising carbon and nitrogen sources and inorganic salts, using procedures known in the art. Suitable media are available from commercial suppliers or may be prepared according to published compositions (eg., in catalogues of the American Type Culture Collection).

Nucleic Acid Probes

The nucleic acid probes from the two or more filamentous fungal cells may be any nucleic acid including genomic DNA, cDNA, and RNA, and may be isolated using standard methods known in the art. For example, cDNA probes may be obtained from the total polyadenylated mRNA isolated from the cells using standard methods and reverse transcribed into total cDNA.

The populations of isolated nucleic acid probes may be labeled with detection reporters such as colorimetric, radioactive, fluorescent reporters, or other reporters using methods known in the art (Chen et al., 1998, *Genomics* 51: 313-324; DeRisi et al., 1997, *Science* 278: 680-686; U.S. Pat. No. 5,770,367).

In a preferred embodiment, the probes are labeled with fluorescent reporters. For example, cDNA probes may be labeled during reverse transcription from the respective mRNA pools by incorporation of fluorophores as dye-labeled nucleotides (DeRisi et al., 1997, supra), e.g., Cy5-labeled deoxyuridine triphosphate, or the isolated cDNAs may be directly labeled with different fluorescent functional groups. Fluorescent-labeled nucleotides include, but are not limited to, fluorescein conjugated nucleotide analogs (green fluorescence) and lissamine nucleotide analogs (red fluorescence). Fluorescent functional groups include, but are not limited to, Cy3 (a green fluorescent dye) and Cy5 (red fluorescent dye).

Array Hybridization

The labeled nucleic acids from the two or more filamentous fungal cells are then added to a substrate containing an array of *Trichoderma reesei* array features under conditions where the nucleic acid pools from the two or more filamentous fungal cells hybridize to complementary sequences of the array features in the array. For purposes of the present invention, hybridization indicates that the labeled nucleic acids from the two or more cells hybridize to the array features under very low to very high stringency conditions.

A small volume of the labeled nucleic acids mixture is loaded onto the substrate. The solution will spread to cover the entire microarray. In the case of a multi-cell substrate, one or more solutions are loaded into each cell which stop at the barrier elements.

The labeled probes are denatured and applied to a microarray slide under a cover glass, placed in a humidified chamber, and incubated overnight (15-16 hours) in a water bath at 63° C. Before scanning, the arrays are washed consecutively in 1×SSC with 0.03% SDS, 0.2×SSC, and 0.05×SSC and centrifuged for 2 minutes at 500 rpm top remove excess liquid. For further details, see Berka et al., 2003, *Proc. Natl. Acad. Sci. USA* 100: 5682-5687.

For nucleic acid probes of at least about 100 nucleotides in length, very low to very high stringency conditions are defined as prehybridization and hybridization at 42° C. in 5×SSPE, 0.3% SDS, 200 μg/ml sheared and denatured salmon sperm DNA, and either 25% formamide for very low and low stringencies, 35% formamide for medium and medium-high stringencies, or 50% formamide for high and very high stringencies, following standard Southern blotting procedures for 12 to 24 hours optimally.

For nucleic acid probes of at least about 100 nucleotides in length, the carrier material is finally washed three times each for 15 minutes using 2×SSC, 0.2% SDS preferably at least at 45° C. (very low stringency), more preferably at least at 50° C. (low stringency), more preferably at least at 55° C. (medium stringency), more preferably at least at 60° C. (medium-high stringency), even more preferably at least at 65° C. (high stringency), and most preferably at least at 70° C. (very high stringency).

For shorter nucleic acid probes which are about 50 nucleotides to about 100 nucleotides in length, stringency conditions are defined as prehybridization, hybridization, and washing post-hybridization at 5° C. to 10° C. below the calculated $T_m$ using the calculation according to Bolton and McCarthy (1962, *Proceedings of the National Academy of Sciences USA* 48:1390) in 0.9 M NaCl, 0.09 M Tris-HCl pH 7.6, 6 mM EDTA, 0.5% NP-40, 1× Denhardt's solution, 1 mM sodium pyrophosphate, 1 mM sodium monobasic phosphate, 0.1 mM ATP, and 0.2 mg of yeast RNA per ml following standard Southern blotting procedures for 12 to 24 hours optimally.

For shorter nucleic acid probes which are about 50 nucleotides to about 100 nucleotides in length, the carrier material is washed once in 6×SCC plus 0.1% SDS for 15 minutes and twice each for 15 minutes using 6×SSC at 5° C. to 10° C. below the calculated $T_m$.

The choice of hybridization conditions will depend on the degree of homology between the *Trichoderma reesei* array features and the nucleic acids obtained from the two or more filamentous fungal cells. For example, where the cells are the same cell from which the array features were obtained, high stringency conditions may be most suitable. Where the cells are from a genus or species different from which the *Trichoderma reesei* array features were obtained, low or medium stringency conditions may be more suitable.

In a preferred embodiment, the hybridization is conducted under low stringency conditions. In a more preferred embodiment, the hybridization is conducted under medium stringency conditions. In a most preferred embodiment, the hybridization is conducted under high stringency conditions.

The entire solid support is then reacted with detection reagents, if needed, and analyzed using standard calorimetric, radioactive, or fluorescent detection means. All processing and detection steps are performed simultaneously to all of the microarrays on the solid support ensuring uniform assay conditions for all of the microarrays on the solid support.

Detection

The most common detection method is laser-induced fluorescence detection using confocal optics (Cheung et al., 1998, Nat. Genet. 18: 225-230). The array is examined under fluorescence excitation conditions such that (i) the Trichoderma reesei array features in the array that hybridize to the nucleic acid probes obtained from one of the first cell and one or more second cells produces a distinct first fluorescence emission color or one or second fluorescence emission colors, respectively, and (ii) the Trichoderma reesei ESTs or SSH clones, or a combination thereof, in the array that hybridize to substantially equal numbers of nucleic acid probes obtained from the first cell and one of the one or more second cells produce a distinct combined fluorescence emission color, respectively; wherein the relative expression of the genes in the two or more cells can be determined by the observed fluorescence emission color of each spot in the array.

The fluorescence excitation conditions are based on the selection of the fluorescence reporters. For example, Cy3 and Cy5 reporters are detected with solid state lasers operating at 532 nm and 650 nm, respectively.

However, other methods of detection well known in the art may be used such as standard photometric, calorimetric, or radioactive detection means, as described earlier.

In a preferred embodiment, the methods comprise (a) adding a mixture of fluorescence-labeled nucleic acids isolated from the filamentous fungal cells to a substrate containing an array of Trichoderma reesei ESTs or SSH clones, or a combination thereof, selected from the group consisting of SEQ ID NOs. 1-1188, nucleic acid fragments of SEQ ID NOs. 1-1188, and nucleic acid sequences having at least 90% homology to SEQ ID NOs. 1-1188, under conditions where the nucleic acids hybridize to complementary sequences of the ESTs or SSH clones; or a combination thereof; in the array, wherein the nucleic acids from the first filamentous fungal cell and the one or more second filamentous fungal cells are labeled with a first fluorescent reporter and one or more different second fluorescent reporters, respectively; and (b) examining the array by fluorescence under fluorescence excitation conditions wherein the relative expression of the genes in the filamentous fungal cells is determined by the observed fluorescence emission color of each spot in the array in which (i) the Trichoderma reesei ESTs or SSH clones, or a combination thereof, in the array that hybridize to the nucleic acids obtained from either the first or the one or more second filamentous fungal cells produce a distinct first fluorescence emission color or one or more second fluorescence emission colors, respectively, and (ii) the Trichoderma reesei ESTs or SSH clones; or a combination thereof; in the array that hybridize to the nucleic acids obtained from both the first and one or more second filamentous fungal cells produce a distinct combined fluorescence emission color.

Data Analysis

The data obtained from the scanned image may then be analyzed using any of the commercially available image analysis software. The software preferably identifies array elements, subtracts backgrounds, deconvolutes multi-color images, flags or removes artifacts, verifies that controls have performed properly, and normalizes the signals (Chen et al., 1997, Journal of Biomedical Optics 2: 364-374).

Several computational methods have been described for the analysis and interpretation of microarray-based expression profiles including cluster analysis (Eisen et al., 1998, Proc. Nat. Acad. Sci. USA 95: 14863-14868), parametric ordering of genes (Spellman et al., 1998, Mol. Biol. Cell 9: 3273-3297), and supervised clustering methods based on representative hand-picked or computer-generated expression profiles (Chu et al., 1998. Science 282: 699-705). Preferred methods for evaluating the results of the microarrays employ statistical analysis to determine the significance of the differences in expression levels. In the methods of the present invention, the difference in the detected expression level is at least about 10% or greater, preferably at least about 20% or greater, more preferably at least about 50% or greater, even more preferably at least about 75% or greater; and most preferably at least about 100% or greater.

One such preferred system is the Significance Analysis of Microarrays (SAM) (Tusher et al., 2001, Proc. Natl. Acad. Sd. USA 98: 5116-5121). Statistical analysis allows the determination of significantly altered expression of levels of about 50% or even less. The PAM (or predictive analysis for microarrays) represents another approach for analyzing the results of the microarrays (Tibshirani et al., 2002, Proc. Natl. Acad. Sci. USA 99: 6567-6572).

Cluster algorithms may also be used to analyze microarray expression data. From the analysis of the expression profiles it is possible to identify co-regulated genes that perform common metabolic or biosynthetic functions. Hierarchical clustering has been employed in the analysis of microarray expression data in order to place genes into clusters based on sharing similar patterns of expression (Eisen et al., 1998, supra). This method yields a graphical display that resembles a kind of phylogenetic tree where the relatedness of the expression behavior of each gene to every other gene is depicted by branch lengths. The programs Cluster and TreeView, both written by Michael Eisen (Eisen et al., 1998 Proc. Nat Acad. Sci. USA 95: 14863-14868) are freely available. Genespring is a commercial program available for such analysis (Silicon Genetics, Redwood City, Calif.).

Self-organizing maps (SOMs), a non-hierarchical method, have also been used to analyze microarray expression data (Tamayo et al., 1999, Proc. Natl. Acad. Sci. USA 96: 2907-2912). This method involves selecting a geometry of nodes, where the number of nodes defines the number of clusters. Then, the number of genes analyzed and the number of experimental conditions that were used to provide the expression values of these genes are subjected to an iterative process (20,000-50,000 iterations) that maps the nodes and data points into multidimensional gene expression space. After the identification of significantly regulated genes, the expression level of each gene is normalized across experiments. As a result, the expression profile of the genome is highlighted in a manner that is relatively independent of each gene's expression magnitude. Software for the "GENECLUSTER" SOM program for microarray expression analysis can be obtained from the Whitehead/MIT Center for Genome Research. SOMs can also be constructed using the GeneSpring software package.

Computer Readable Media

The *Trichoderma reesei* array features described herein may be "provided" in a variety of mediums to facilitate their use. The term "provided" refers to a manufacture comprising an array of *Trichoderma* array features. Such manufactures provide a large portion of the genomes of *Trichoderma reesei* and parts thereof (e.g., an open reading frame (ORF)) in a form which allows one skilled in the art to examine the manufacture using means not directly applicable to examining the genome or a subset thereof as it exists in nature or in purified form.

Thus, the present invention also relates to such a manufacture in the form of a computer readable medium comprising an array of *Trichoderma reesei* ESTs or SSH clones, or a combination thereof. In a preferred embodiment, the computer readable medium comprises an array of *Trichoderma reesei* ESTs or SSH clones, or a combination thereof, selected from the group consisting of SEQ ID NOs. 1-1188, nucleic acid fragments of SEQ ID NOs. 1-1188, or nucleic acid sequences having at least 95%, preferably at least 99% and most preferably at least 99.9% homology to a sequence of SEQ ID NOs. 1-1188. In another preferred embodiment, the computer readable medium comprises an array of *Trichoderma reesei* ESTs or SSH clones, or a combination thereof, selected from the group consisting of SEQ ID NOs. 1-1188.

In one application of this embodiment, the *Trichoderma reesei* array features can be recorded on computer readable media. The term "computer readable media" is defined herein as any medium which can be read and accessed directly by a computer. Such computer readable media include, but are not limited to, magnetic storage media, e.g., floppy discs, hard disc storage medium, and magnetic tape; optical storage media, e.g., CD-ROM, DVD; electrical storage media, e.g., RAM and ROM; and hybrids of these categories, e.g., magnetic/optical storage media. One skilled in the art can readily appreciate how any of the presently known computer readable media can be used to create a manufacture comprising computer readable medium having recorded thereon nucleotide sequences of the *Trichoderma reesei* array features of the present invention. Likewise, it will be clear to those of skill how additional computer readable media that may be developed also can be used to create analogous manufactures having recorded thereon nucleotide sequences of the *Trichoderma reesei* array features.

As used herein, "recorded" refers to a process for storing information on computer readable medium. One skilled in the art can readily adopt any of the presently known methods for recording information on computer readable medium to generate manufactures comprising the nucleotide sequence information of the present invention.

A variety of data storage structures are available for creating a computer readable medium having recorded thereon the *Trichoderma reesei* array features of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data-processor structuring formats (e.g., text file or database) in order to obtain computer readable medium having recorded thereon the nucleotide sequence information of the present invention.

Various computer software are publicly available that allow a skilled artisan to access sequence information provided in a computer readable medium. Thus, by providing in computer readable form an array of *Trichoderma reesei* ESTs or SSH clones, or a combination thereof, selected from the group consisting of SEQ ID NOs. 1-1188, nucleic acid fragments of SEQ ID NOs. 1-1188, and nucleic acid sequences having at least 90%, preferably at least 95%, more preferably at least 99%, and most preferably at least 99.9% homology to SEQ ID NOs. 1-1188 enables one skilled in the art to routinely access the provided sequence information for a wide variety of purposes.

Software utilizing the BLAST (Altschul et al., 1990, *Journal of Molecular Biology* 215: 403-410) and BLAZE (Brutlag et al., 1993, *Comp. Chem.* 17: 203-207) search algorithms may be used to identify open reading frames (ORFs) within a genome of interest, which contain homology to ORFs or proteins from *Trichoderma reesei* and from other organisms. Among the ORFs discussed herein are protein encoding fragments of the *Trichoderma reesei* genome useful in producing commercially important proteins, such as enzymes, and in the production of commercially useful metabolites.

The present invention further provides systems, particularly computer-based systems, which contain the sequence information described herein. Such systems are designed to identify, among other things, genes and gene products—many of which could be products themselves or used to genetically modify an industrial expression host through increased or decreased expression of a specific gene sequence(s).

The term "a computer-based system" is defined herein as a hardware means, software means, and data storage means used to analyze the nucleotide sequence information of the present invention. The minimum hardware means of the computer-based systems of the present invention comprises a central processing unit (CPU), input means, output means, and data storage means. One skilled in the art can readily appreciate that any currently available computer-based system is suitable for use in the present invention.

As stated above, the computer-based systems of the present invention comprise a data storage means having stored therein nucleic acid sequences of the *Trichoderma reesei* array features and the necessary hardware means and software means for supporting and implementing a search means.

The term "data storage means" is defined herein as memory which can store nucleotide sequence information of the present invention, or a memory access means which can access manufactures having recorded thereon the nucleotide sequence information of the present invention.

The term "search means" is defined herein as one or more programs which are implemented on the computer-based system to compare a target sequence or target structural motif with the sequence information stored within the data storage means. Search means are used to identify fragments or regions of the present sequences which match a particular target sequence or target motif. A variety of known algorithms are disclosed publicly and a variety of commercially available software for conducting search means are and can be used in the computer-based systems of the present invention. Examples of such software includes, but is not limited to, MacPattern (Fuchs, 1991, *Comput Appl. Biosci.* 7: 105-106), BLASTN and BLASTX (NCBI). One skilled in the art can readily recognize that any one of the available algorithms or implementing software packages for conducting homology searches can be adapted for use in the present computer-based systems.

The term "target sequence" is defined herein as any DNA or amino acid sequence of six or more nucleotides or two or more amino acids. One skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that searches for commercially important fragments, such as sequence fragments involved in gene expression and protein processing, may be of shorter length.

The term "a target structural motif" or "target motif" is defined herein as any rationally selected sequence or combination of sequences chosen based on a three-dimensional configuration which is formed upon the folding of the target motif. There are a variety of target motifs known in the art. Protein target motifs include, but are not limited to, enzyme active sites and signal sequences, substrate and cofactor binding domains, transmembrane domains, and sites for post-translational modifications. Nucleic acid target motifs include, but are not limited to, promoter sequences, hairpin structures and inducible expression elements (protein binding sequences), repeats, palindromes, dyad symmetries, intron-exon boundaries, transcription and translation start and stop sites, and polyadenylation signals.

A variety of structural formats for the input and output means can be used to input and output the information in the computer-based systems of the present invention. A preferred format for an output means ranks fragments of the nucleic acid sequences possessing varying degrees of homology to the target sequence or target motif. Such presentation provides one skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of a genome. For example, implementing software which utilize the BLAST and BLAZE algorithms, described in Altschul et al., 1990, *Journal of Molecular Biology* 215: 403-410, may be used to identify open reading frames within the *Trichoderma reesei* genome or the genomes of other organisms. A skilled artisan can readily recognize that any one of the publicly available homology search programs can be used as the search means for the computer-based systems of the present invention. Of course, suitable proprietary systems that may be known to those of skill also may be employed in this regard.

Substrates

The present invention also relates to substrates as described herein comprising an array of *Trichoderma reesei* ESTs or SSH clones, or a combination thereof. In a preferred embodiment, the substrate comprises an array of *Trichoderma reesei* ESTs or SSH clones, or a combination thereof, selected from the group consisting of SEQ ID NOs. 1-1188, nucleic acid fragments of SEQ ID NOs. 1-1188, or nucleic acid sequences having at least 95%, preferably at least 99% and most preferably at least 99.9% homology to a sequence of SEQ ID NOs. 1-1188. In a more preferred embodiment, the substrate comprises an array of *Trichoderma reesei* ESTs or SSH clones, or a combination thereof, selected from the group consisting of SEQ ID NOs. 1-1188.

The present invention is further described by the following examples which should not be construed as limiting the scope of the invention.

EXAMPLES

Chemicals used as buffers and substrates were commercial products of at least reagent grade.

Example 1

Fermentation and Mycelial Tissue

*Trichoderma reesei* strain RutC30 (Montenecourt and Eveleigh, 1979, *Adv. Chem. Ser.* 181: 289-301) was cultivated in a pilot scale fermentation tank in growth medium containing a complex carbon source. The carbon sources included glucose, cellulose, or pre-treated and washed corn stover. Fungal mycelium was collected from a one-liter sample, and immediately frozen in liquid $N_2$ and stored at −80° C.

Pretreated corn stover (PCS) was obtained from U.S. Department of Energy National Renewable Energy Laboratory (NREL). The water-insoluble solids in PCS include: 56.5% cellulose, 4.6% hemicellulose, and 28.4% lignin. Pretreatment conditions were: corn stover, 1.4% (wt/vol) sulfuric acid, 165° C., 107 psi, for 8 minutes. Prior to assay, PCS was washed with a large volume of distilled deionized water on a glass filter. PCS was then milled using a coffee grinder to reduce particle size, then washed further with water on a 22 µm Millipore filter (6P Express Membrane, Stericup, Millipore, Billerica, Mass.). The washed PCS was resuspended in deionized water to make a 20 mg/ml suspension, and stored at 4° C.

Example 2

*Trichoderma reesei* Directional cDNA Library Construction

Total RNA was prepared from the *Trichoderma reesei* mycelial samples described in Example 1 by extraction with guanidinium thiocyanate followed by ultracentrifugation through a 5.7 M CsCl cushion (Chirgwin et al., 1979, *Biochemistry* 18: 5294-5299) using the following modifications. The frozen mycelia were ground in liquid $N_2$ to a fine powder with a mortar and a pestle, followed by grinding in a precooled coffee mill, and immediately suspended in 5 volumes of RNA extraction buffer (4 M guanidinium thiocyanate, 0.5% sodium laurylsarcosine, 25 mM sodium citrate pH 7.0, 0.1 M β-mercaptoethanol). The mixture was stirred for 30 minutes at room temperature and centrifuged (20 minutes at 12,000×g) to pellet the cell debris. The supernatant was collected, carefully layered onto a 5.7 M CsCl cushion (5.7 M CsCl, 10 mM EDTA, pH 7.5, 0.1% DEPC; autoclaved prior to use) using 26.5 ml supernatant per 12.0 ml of CsCl cushion, and centrifuged to obtain the total RNA (Beckman SW 28 rotor, 25,000 rpm, room temperature, 24 hours). After centrifugation the supernatant was carefully removed and the bottom of the tube containing the RNA pellet was cut off and rinsed with 70% ethanol. The total RNA pellet was transferred to an Eppendorf tube, suspended in 500 µl of TE (10 mM Tris-0.1 mM EDTA), pH 7.6 (if difficult, heated occasionally for 5 minutes at 65° C.), phenol extracted, and precipitated with ethanol for 12 hours at −20° C. (2.5 volumes of ethanol, 0.1 volume of 3M sodium acetate pH 5.2). The RNA was collected by centrifugation (30 minutes at 12,000×g), washed in 70% ethanol, and resuspended in a minimum volume of DEPC-treated water. The total RNA concentration was determined by measuring the absorbance at 260 nm.

Poly(A)$^+$ RNA was isolated by oligo(dT)-cellulose affinity chromatography (Aviv & Leder, 1972, *Proceedings of the National Academy of Sciences USA* 69: 1408-1412). A total of 0.2 g of oligo(dT) cellulose (Boehringer Mannheim, Indianapolis, Ind.) was pre-swollen in 10 ml of 1× of column loading buffer (20 mM Tris-Cl, pH 7.6, 0.5 M NaCl, 1 mM EDTA, 0.1% SDS), loaded onto a DEPC-treated, plugged plastic column (Poly Prep Chromatography Column, Bio-Rad, Hercules, Calif.), and equilibrated with 20 ml of 1× loading buffer. The total RNA (1-2 mg) was heated at 65° C. for 8 minutes, quenched on ice for 5 minutes, and after addition of 1 volume of 2× column loading buffer loaded onto the column. The eluate was collected and reloaded 2-3 times by heating the sample as above and quenching on ice prior to each loading. The oligo(dT) column was washed with 10 volumes of 1× loading buffer, then with 3 volumes of medium salt buffer (20 mM Tris-Cl, pH 7.6, 0.1 M NaCl, 1 mM EDTA, 0.1% SDS), followed by elution of the poly(A)$^+$ RNA with 3 volumes of elution buffer (10 mM Tris-Cl pH 7.6, 1 mM EDTA, 0.05% SDS) preheated to 65° C., by collecting 500 µl fractions. The absorbance at 260 nm was read for each collected fraction, and the mRNA containing fractions were pooled and ethanol precipitated at −20° C. for 12 hours. The poly(A)$^+$ RNA was collected by centrifugation, resuspended in DEPC-treated water, and stored in 5-10 µg aliquots at −80° C.

Double-stranded Eco RI-Not I-directional cDNA was synthesized from 5 µg of *Trichoderma reesei* RutC30 poly (A)$^+$ RNA by the RNase H method (Gubler and Hoffman 1983, *Gene* 25: 263-270; Sambrook et al., 1989, Molecular Cloning, a Laboratory Manual. Cold Spring Harbor Laboratory Press, Cold Spring Harbor, N.Y.) using a hair-pin modification. The poly(A)$^+$ RNA (5 µg in 5 µl of DEPC-treated water) was heated at 70° C. for 8 minutes in a pre-siliconized, RNase-free Eppendorf tube, quenched on ice, and combined in a final volume of 50 µl with reverse transcriptase buffer (50 mM Tris-Cl pH 8.3, 75 mM KCl, 3 mM MgCl$_2$, 10 mM DTT) containing 1 mM of dATP, dGTP and dTTP, 0.5 mM of 5-methyl-dCTP, 40 units of human placental ribonuclease inhibitor (Promega, Madison, Wis.), 4.81 µg of oligo(dT)$_{18}$-Not I primer, and 1000 units of SuperScript II RNase H—reverse transcriptase (Life Technologies, Inc., Rockville, Md.). First-strand cDNA was synthesized by incubating the reaction mixture at 45° C. for 1 hour. After synthesis, the mRNA:cDNA hybrid mixture was gel filtrated through a MicroSpin S400 HR spin column (Amersham Biosciences, Piscataway, N.J.) according to the manufacturer's instructions.

After the gel filtration, the hybrids were diluted in 250 µl of second strand buffer (20 mM Tris-Cl pH 7.4, 90 mM KCl, 4.6 mM MgC$_2$, 10 mM (NH$_4$)$_2$SO$_4$, 0.16 mM NAD$^+$) containing 200 µM of each dNTP, 60 units of *E. coli* DNA polymerase I (Amersham Biosciences, Piscataway, N.J.), 5.25 units of RNase H, and 15 units of *E. coli* DNA ligase (New England Biolabs, Inc., Beverly, Mass.). Second strand cDNA synthesis was performed by incubating the reaction tube at 16° C. for 2 hours, and an additional 15 minutes at 25° C. The reaction was stopped by addition of EDTA to 20 mM final concentration followed by phenol and chloroform extractions.

The double-stranded cDNA was ethanol precipitated at −20° C. for 12 hours by addition of 2 volumes of 96% ethanol and 0.2 volume of 10 M ammonium acetate, recovered by centrifugation, washed in 70% ethanol, dried (SpeedVac), and resuspended in 30 µl of Mung bean nuclease buffer (30 mM sodium acetate pH 4.6, 300 mM NaCl, 1 mM ZnSO$_4$, 0.35 mM dithiothreitol, 2% glycerol) containing 25 units of Mung bean nuclease. The single-stranded hair-pin DNA was clipped by incubating the reaction at 30° C. for 30 minutes, followed by addition of 70 µl of 10 mM Tris-Cl, pH 7.5, 1 mM EDTA, phenol extraction, and ethanol precipitation with 2 volumes of 96% ethanol and 0.1 volume 3 M sodium acetate pH 5.2 on ice for 30 minutes.

The double-stranded cDNAs were recovered by centrifugation (30,000×g for 30 minutes), and blunt-ended with T4 DNA polymerase in 30 µl of T4 DNA polymerase buffer (20 mM Tris-acetate, pH 7.9, 10 mM magnesium acetate, 50 mM potassium acetate, 1 mM dithiothreitol) containing 0.5 mM of each dNTP, and 5 units of T4 DNA polymerase by incubating the reaction mixture at 16° C. for 1 hour. The reaction was stopped by addition of EDTA to 20 mM final concentration, followed by phenol and chloroform extractions and ethanol precipitation for 12 hours at −20° C. by adding 2 volumes of 96% ethanol and 0.1 volume of 3 M sodium acetate pH 5.2.

After the fill-in reaction, cDNA was recovered by centrifugation as above, washed in 70% ethanol, and the DNA pellet was dried in a SpeedVac. The cDNA pellet was resuspended in 25 µl of ligation buffer (30 mM Tris-Cl, pH 7.8, 10 mM MgCl$_2$, 10 mM dithiothreitol, 0.5 mM ATP) containing 2 µg Eco RI adaptors (0.2 µg/µl, Amersham Biosciences, Piscataway, N.J.) and 20 units of T4 ligase (Roche Molecular Biochemicals, Indianapolis, Ind.) by incubating the reaction mix at 16° C. for 12 hours. The reaction was stopped by heating at 65° C. for 20 minutes, and then placed on ice for 5 minutes. The adapted cDNA was digested with Not I by addition of 20 µl autoclaved water, 5 µl of 10× Not I restriction enzyme buffer, and 50 units of Not I, followed by incubation for 3 hours at 37° C. The reaction was stopped by heating the sample at 65° C. for 15 minutes. The cDNAs were size-fractionated by agarose gel electrophoresis on a 0.8% SeaPlaque GTG low melting temperature agarose gel (FMC, Rockland, Me.) in 44 mM Tris Base, 44 mM boric acid, 0.5 mM EDTA (TBE) buffer (in autoclaved water) to separate unligated adaptors and small cDNAs. The gel was run for 12 hours at 15 V, and the cDNA was size-selected with a cut-off at 0.7 kb by cutting out the lower part of the agarose gel. Then a 1.5% agarose gel was poured in front of the cDNA-containing gel, and the double-stranded cDNAs were concentrated by running the gel backwards until it appeared as a compressed band on the gel. The cDNA-containing gel piece was cut out from the gel and the cDNA was extracted from the gel using a GFX Gel Band Purification Kit (Amersham, Arlington Heights, Ill.) as follows. The trimmed gel slice was weighed in a 2 ml nuclease-free microcentrifuge tube (ISC BioExpress, Kaysville, Utah) then 10 ml of Capture Buffer (Amersham, Arlington Heights, Ill.) was added for each 10 mg of gel slice, the gel slice was dissolved by incubation at 60° C. for 10 minutes, until the agarose was completely solubilized, and the sample was then pelleted by a brief centrifugation (2 minutes at 8,000×g). The melted sample was transferred to a GFX spin column placed in a collection tube, incubated at 25° C. for 1 minute, and then centrifuged at full speed (15,000×g) in a microcentrifuge for 30 seconds. The flow-through was discarded, and the column was washed with 500 µl of wash buffer (GFX Gel Band Purification Kit, Amersham, Arlington Heights, Ill.) followed by centrifugation at full speed for 30 seconds. The collection tube was discarded, and the column was placed in a 1.5 ml Eppendorf tube, followed by elution of the cDNA by addition of 50 µl of TE pH 7.5 to the center of the column, incubation at 25° C. for 1 minute, and finally by centrifugation for 1 minute at maximum speed (15,000×g). The eluted cDNA was stored at −20° C. until library construction.

A plasmid DNA preparation for a Eco RI-Not I insert-containing pYES2.0 cDNA clone, was purified using a QIAGEN Tip-100 according to the manufacturer's instructions (QIAGEN, Valencia, Calif.). A total of 10 µg of purified plasmid DNA was digested to completion with Not I and Eco RI in a total volume of 60 µl by addition of 6 µl of 10× NEBuffer for Eco RI (New England Biolabs, Beverly, Mass.), 40 units of Not I, and 20 units of Eco RI followed by incubation for 6 hours at 37° C. The reaction was stopped by heating the sample at 65° C. for 20 minutes. The digested plasmid DNA was extracted once with phenol-chloroform, then with chloroform, followed by ethanol precipitation for 12 hours at −20° C. by adding 2 volumes of 96% ethanol and 0.1 volume of 3 M sodium acetate pH 5.2. The precipitated DNA was resuspended in 25 µl of TE pH 7.5, loaded onto a 0.8% SeaKem agarose gel in TBE buffer, and run for 3 hours at 60 V. The digested vector was cut out from the gel, and the DNA was extracted from the gel using a GFX Gel Band Purification Kit according to the manufacturer's instructions. After measuring the DNA concentration by absorbance at 260 nm, the eluted vector was stored at −20° C. until library construction.

To establish the optimal ligation conditions for the cDNA library, four test ligations were done in 10 µl of ligation buffer (30 mM Tris-Cl pH 7.8, 10 mM $MgCl_2$, 10 mM DTT, 0.5 mM ATP) containing 7 µl of double-stranded cDNA (corresponding to approximately 1/10 of the total volume in the cDNA sample), 2 units of T4 ligase, and 25 ng, 50 ng and 75 ng of Eco RI-Not I cleaved pYES2.0 vector, respectively (Invitrogen, Carlsbad, Calif.). The vector background control ligation reaction contained 75 ng of Eco RI-Not I cleaved pYES.0 vector without cDNA. The ligation reactions were performed by incubation at 16° C. for 12 hours, heated at 65° C. for 20 minutes, and then 10 µl of autoclaved water was added to each tube. One µl of the ligation mixtures was electroporated (200 W, 2.5 kV, 25 mF) to 40 µl of electrocompetent *E. coli* DH10B cells (Life Technologies, Gaithersburg, Md.). After addition of 1 ml of SOC medium (Birren et al., 1998. *Genome Analysis, Vol.* 2. *Detecting Genes*. Cold Spring Harbor Laboratory Press, Cold Spring Harbor, N.Y.) to each transformation mix, the cells were grown at 37° C. for 1 hour. Then 50 µl and 5 µl from each electroporation were plated on LB plates composed per liter of 10 g/L of tryptone, 5 g/L of yeast extract, 5 g/L of NaCl, and 15 g/L of agar, and supplemented with ampicillin at 100 µg per ml and grown at 37° C. for 12 hours. Using the optimal conditions, a *Trichoderma reesei* RutC30 cDNA library containing 1-2.5×10$^7$ independent colony forming units was established in *E. coli*, with a vector background of ca. 1%. The cDNA library was stored as (1) individual pools (25,000 c.f.u./pool) in 20% glycerol at −80° C.; (2) cell pellets of the same pools at −20° C.; (3) QIAGEN Tip 100 purified plasmid DNA from individual pools at −20° C.; and (4) directional, double-stranded cDNA at −20° C.

Example 3

*Trichoderma reesei* EST Template Preparation

Plasmid DNAs from individual *E. coli* colonies from the cDNA libraries described in Example 2 were purified using a 96-well manifold plasmid preparation system (QIAGEN, Valencia, Calif.) according to instructions supplied by the manufacturer.

Example 4

*Trichoderma reesei* Genomic Library Construction

Genomic DNA from *Trichoderma reesei* RutC30 cells grown for two days at 34° C. in 100 ml of YEG medium (0.5% yeast extract, 2% glucose) was purified using a DNeaSy™ Slant System (QIAGEN, Valencia, Calif.). The DNA was subsequently sheared by nebulization (10 psi, 180 seconds in 2 ml volume), separated by preparative gel electrophoresis (Maniatis et al., 1982. Molecular Cloning, A Laboratory Manual, Cold Spring Harbor Laboratory Press, Cold Spring Harbor, N.Y.), and a fraction that was enriched for 2-3 kb fragments was excised and purified with a Gel Extraction Kit (QIAGEN, Valencia, Calif.). The DNA ends were made blunt using Klenow DNA polymerase and dephosphorylated with calf intestinal phosphatase (CIP) (Roche Diagnostics, Indianapolis, Ind.).

The DNA was purified again after CIP treatment and ligated with a pCR4BIunt-TOPO (Invitrogen, Carlsbad, Calif.) vector at molar ratios of 5:1 and 10:1. This cloning reaction was used to transform electrocompetent *E. coli* TOP10 cells (Invitrogen, Carlsbad, Calif.) and 10 µl of each transformation mix was plated on LB plates containing 100 µg of ampicillin per ml and 250 µg of X-Gal per ml for blue/white screening of recombinants. The transformation efficiencies using 5:1 and 10:1 molar ratios of insert-to-vector were 2.1×10$^6$ and 1.8×10$^6$ cfu/µg, respectively. Among the transformants, approximately 90% were white and light blue colonies, presumably carrying plasmids with *Trichoderma reesei* DNA inserts. Ten representative white or light blue colonies from each transformation were used for plasmid DNA preparation and restriction analysis using Eco RI to check the proportion of true recombinants among the transformants. It was found that 7 out of 10 (from the 5:1 molar ratio) and 10 out of 10 (from the 10:1 molar ratio) plasmids carried *Trichoderma reesei* DNA inserts with sizes ranging from 2-3 kb. Based on the favorable results of the restriction analyses, the remaining *E. coli* cells were plated from the second ligation mix (insert:vector DNA ratio 10:1). A Qpix robot (Genetix Ltd., Hampshire, UK) was then used to pick the white and light blue colonies into the 96-well plates containing LB medium supplemented with 100 µg of ampicillin per ml. After overnight incubation at 37° C. an equivalent amount of 50% glycerol was added to each well, and the plates were taped with "Petri Seal" and stored at −80° C. for later use. In total, approximately 2×10$^5$ colonies were obtained with a colony density of 300-700 per 150 mm plate. Approximately 45,000 colonies were picked, grown overnight in selective medium, and frozen in microtiter plates. This number is sufficient to give about 3× coverage of the genome of *Trichoderma reesei* (ca. 94% probability of cloning every gene in the genome at least once).

Example 5

Isolation of *Trichoderma reesei* Genomic Inserts

Individual plasmid DNAs bearing the *Trichoderma reesei* genomic inserts from each of the clones described in Example 4 were isolated using rolling circle amplification (RCA) using a TempliPhi Kit (Amersham Biosciences, Piscataway, N.J.). The same 96-well plate containing individual clones was used to inoculate a second 96-well plate with one milliliter of LB medium composed per liter of 10 g of tryptone, 5 g of yeast extract, and 5 g of NaCl, and supplemented with 100 µg of ampicillin per ml for the conventional plasmid DNA isolation and to perform the RCA. Using RCA, approximately the same amount of high molecular weight DNA product was found in all 96 wells. To assure that this product represented the expected linear multimers of plasmid DNA, all 96 DNA preparations was treated with Eco RI to digest the multimers and to release the insert DNA. In 87 out of 96 digests (91%), both vector and insert DNAs were found. In just 9 samples the Eco RI digestion generated empty vector DNA.

The conditions of rolling circle amplification were optimized for the purpose of DNA microarray production to minimize the volume of starting cell material added to the TempliPhi reaction, as the RCA method is very sensitive to inhibitors from components of saturated culture medium. Moreover, excess of cell material in the reaction results in higher background of cell debris and chromosomal DNA, which might adversely impact signal-to-noise ratios during microarray experiments. Because it is difficult to transfer very small volumes, serial two-fold dilutions (from 2 to 2112) of the original culture material from eight clones in sterile TE buffer were made, and 1 µl from each diluted sample was transferred into a 96-well plate containing Denaturing Buffer (TempliPhi Kit, Amersham Biosciences, Piscataway, N.J.). Following the required incubation period for DNA amplification, one microliter of each RCA product was digested with Eco RI and analyzed by 1% agarose gel electrophoresis using TBE buffer to evaluate the quality of the reactions. The best results (highest yields of DNA and approximately equivalent yields) were obtained with dilutions in the range of 8 to 32 times. Higher dilutions resulted in less consistent DNA yields.

A larger scale trial with 96 clones, using 8-fold dilution, was done as a pilot for future microarray experiments. The RCA products were subsequently digested with Eco RI and analyzed on agarose gels as described above. All samples showed similar yields of DNA product, which was also confirmed by spectrophotometric measurement of DNA concentrations. An average yield of DNA from the RCA reactions was 500 ng/µl. This concentration of DNA allows dilution of the reaction products several times before printing onto microarray slides and avoids a DNA precipitation step, which could result in loss of plasmid DNA.

Example 6

Trichoderma reesei SSH Library Construction

Total cellular RNA was isolated from frozen cells grown on glucose, cellulose, or pre-treated corn stover (Example 1) using slight modifications to the method of Timberlake and Barnard, 1981, *Cell* 26: 29-37. RNA extraction buffer was prepared by adding a freshly prepared solution of p-aminosalicylic acid (9.6 g in 80 ml of DEPC-treated water) to a solution of triisopropylnaphthalene sulfonic acid (1.6 g in 80 ml of DEPC-treated water). This mixture was added to 40 ml of 5× RNB solution (1 M tris-HCl, pH 8.5, 1.25 M NaCl, 0.25 M EGTA) with stirring. Frozen mycelia were ground to a fine powder in an electric coffee grinder with a few chips of dry ice. The ground mycelia were poured directly into 20 ml of RNA extraction buffer on ice, and an equal volume of TE-saturated phenol was added. After vigorous agitation, the samples were centrifuged at 2500 rpm (Sorvall RT7 centrifuge equipped with a H1000B rotor) for 10 minutes to separate phases. The aqueous phase was transferred to a new tube that contained 10 ml of phenol and 10 ml of chloroform-isoamyl alcohol (24:1), while an additional 5 ml of extraction buffer was added to the phenol phase. The latter mixture was incubated at 68° C. for 5 minutes to liberate RNA trapped in polysomes and in the interface material. Following the incubation, the tubes were centrifuged at 2500 rpm (Sorvall RT7 centrifuge equipped with a H1000B rotor) for 10 minutes and the aqueous phase was combined with that obtained from the first extraction. These mixtures were subjected to repeated extraction with phenol-chloroform until there was no longer protein at the interface (usually five or six times). The RNA was recovered by centrifugation (30 minutes at 12,000×g) following precipitation with 0.3 M sodium acetate pH 5.2 and 50% isopropanol. From each sample consisting of approximately 1-2 grams of frozen mycelia generated in laboratory-scale fermentors, 0.4-1.8 mg of total cellular RNA was obtained.

The quality of RNA from cultures grown on cellulose and PCS was appraised by formaldehyde-agarose gel electrophoresis followed by Northern blotting and hybridization (Thomas, 1980, *Proc. Nat Acad. Sci. USA* 77: 5201-5205) with a *Trichoderma reesei* cbh1 specific probe. The cbh1 probe fragment was amplified by standard PCR methods based on the published nucleotide sequence information available from the EMBL database (accession number E00389). The probes were labeled with horseradish peroxidase (HRP) and hybridized at 55° C. using the buffers and protocols provided in a North2South Direct HRP Labeling and Detection Kit (Pierce, Rockford, Ill.). The blots were washed three times in 2×SSC with 0.1% SDS at 55° C. for five minutes each, followed by three additional washes in 2×SSC (no SDS) for five minutes each. Following exposure of the blot to X-ray film, it was clear that virtually all of the hybridization signal in each lane was contained in a 1.8 kb cbh1 mRNA species that migrated to a position just slightly above the 18S ribosomal RNA band. There was no evidence of significant mRNA degradation on either the autoradiogram or on the ethidium bromide stained gel. Polyadenylated (polyA+) mRNA fractions were purified using an Oligotex™ mRNA Isolation Kit according to the manufacturer's instructions (QIAGEN, Valencia, Calif.). Yields of polyA+ mRNA from each of these samples ranged from 2 µg to 25 µg. Each of the mRNA fractions was subsequently analyzed by Northern blot hybridization using HRP-labeled probes derived from the *Trichoderma reesei* γ-actin and cbh1 genes. The γ-actin probe fragment was amplified by standard PCR methods and the following gene-specific primers.

5'-CCAGACATGACAATGTTGCCGTAG-3' (SEQ ID NO: 1189)

5'-TTTCGCTCTTCCTCACGCCATTG-3' (SEQ ID NO: 1190)

As expected, the hybridization signals were localized in bands that corresponded to the γ-actin and cbh1 mRNAs (ca. 1.2 kb and 1.8 kb, respectively) in each lane, indicating that the mRNA samples were of high quality and suitable for cDNA synthesis.

The suppression subtractive hybridization (SSH) method described by Diatchenko et al., 1996, supra, was used to generate a cDNA pool from *Trichoderma reesei* RutC30 that was both enriched for cellulose- and PCS-induced sequences and normalized to aid in recovery of rare transcripts (FIG. 1). Table 1 below lists the combinations of driver and tester cDNAs used for these experiments.

TABLE 1

Driver and tester cDNA pools used for SSH.

| SSH Reaction | Driver cDNA source | Tester cDNA source |
|---|---|---|
| 1 | Glucose-grown cells | PCS-grown cells |
| 2 | Glucose-grown cells | Cellulose-grown cells |
| 3 | Cellulose-grown cells | PCS-grown cells |

The resulting cDNA pools from the SSH reactions in Table 1 were used to generate subtractive libraries of cellulose- and PCS-induced sequences. For synthesis of cDNA, 400 ng of polyA⁺ mRNA derived from each time point (1-5 days) was combined for a total of 2 μg of template. Synthesis and subtraction of cDNA was done using a PCR-Select™ Kit (Clontech, Palo Alto, Calif.). The methods are based on the procedure of suppression subtractive hybridization (SSH) as outlined by Diatchenko et al., 1996, supra. The overall scheme is shown in FIG. 1. First, mRNA was converted from three separate fermentations of *Trichoderma reesei* RutC30 grown on glucose, cellulose, and PCS into double-stranded cDNA using reagents supplied with the PCR-Select™ Kit (Clontech, Palo Alto, Calif.). The differentially expressed cDNAs were present in both the "tester" cDNA pool (i.e., from cells grown on cellulose or corn stover) and the "driver" cDNA, but were present at much lower levels in the "driver" pool (Table 1). Both of these cDNA pools were digested with the restriction enzyme Rsa I which recognizes a four-base pair palindrome and yields blunt-end fragments (GT|AC). The tester cDNA pool was then divided into two samples and ligated with two different adaptor oligonucleotides (provided with the Clontech PCR-Select™ Kit) resulting in two populations of tester cDNA. The adaptors were designed without 5'-phosphate groups such that only the longer strand of each adaptor could be covalently linked to the 5'-ends of the cDNA.

In the first of two hybridizations using conditions specified in the Clontech PCR-Select™ Kit an excess of driver cDNA was added to each portion of tester cDNA. The mixtures were denatured by heating to 95° C. then allowed to anneal. Four types of molecules were generated by this annealing (designated as a, b, c, and d molecules). Type a molecules included equal concentrations of high- and low-abundance cDNAs, because the second-order kinetics of hybridization were faster for more abundant molecules in the pool which preferentially formed b type molecules. At the same time, type a molecules were significantly enriched for differentially expressed (e.g., cellulose- or PCS-induced) sequences, since common non-target cDNAs formed type c molecules with the driver. In a second hybridization, the two pools of primary hybridized products were combined so that the type a molecules from each tester sample could associate and form new type e hybrids. These were double-stranded tester molecules with different adaptor sequences on each end. Fresh denatured driver cDNA was also added to further enrich the pool of e molecules for differentially expressed sequences.

In the final step of the SSH procedure, the differentially expressed cDNAs were selectively amplified by PCR (conditions specified in the PCR-Select™ Kit) Only type e molecules that have two different primer annealing sites were amplified exponentially.

As a quality check, the cDNA clones from approximately 360 randomly picked colonies were purified by rolling circle amplification using an Amersham TempliPhi Kit and analyzed by DNA sequencing (70 from Reaction 1, 96 from Reaction 2, and 192 from Reaction 3). Clustering of the sequences using Transcript Assembler™ software (Paracel, Inc., Pasadena, Calif.) showed that each pool contained a high percentage of non-redundant clones—76% for Reaction 1, 90% for Reaction 2, and 67% for Reaction 3. In addition, the contigs (overlapping sequences of the same cDNA) identified in this analysis contained on average only two sequences. Collectively, these observations suggested that efficient normalization of the libraries was achieved during the SSH reactions, yielding a low level of redundancy in the corresponding cDNA libraries. These differentially expressed sequences were greatly enriched in the final subtracted cDNA pool, and useful as a hybridization probe or to create a subtractive library.

Subtracted and normalized cDNA fractions generated by the SSH procedure were ligated with pCR11-TOPO (Invitrogen, Carlsbad, Calif.) and the ligation mixtures were used to transform electrocompetent *E. coli* TOP10 cells (Invitrogen, Carlsbad, Calif.). Transformants were selected on LB agar plates (Miller, J. H. 1992. A short course in bacterial genetics. A laboratory manual and handbook for *Escherichia coli* and related bacteria. Cold Spring Harbor Press, Cold Spring Harbor, N.Y.) that contained 250 μg/ml X-Gal (no IPTG) and ampicillin at a final concentration of 100 μg/ml.

In order to evaluate the efficiency of subtraction and normalization in SSH cDNA libraries, two approaches were used: colony hybridization and sequencing of random clones from each SSH library. The procedure for colony hybridization is detailed in Birren et al. 1998. *Genome Analysis, A Laboratory Manual*, Vol. 2, Cold Spring Harbor Press, Cold Spring Harbor, N.Y.). Colony-hybridization analysis included approximately 700 independent clones from each subtracted [PCS minus glucose (SG), cellulose minus glucose (CG), PCS minus cellulose (SC)] and un-subtracted (cellulose, PCS) cDNA libraries with DIG-labeled cbh1 probe (abundant transcript), and y-actin probe, a moderately abundant transcript representing a house-keeping gene (Table 2).

TABLE 2

Colony hybridization of SSH libraries probed with cbh1 and γ-actin cDNA fragments.

| Library | Frequency cbh1 | Frequency γ-actin |
|---|---|---|
| Cellulose (no SSH) | 3.3% | <0.17% |
| PCS (no SSH) | 3.7% | 0.13% |
| PCS minus glucose | 0.4% | ND |
| Cellulose minus glucose | 0.5% | ND |
| PCS minus cellulose | 0.1% | ND |

ND, not detected.

While the cbh1 was a rather abundant in the non-subtracted cellulose and PCS libraries (3.3% and 3.6% correspondingly), the subtracted SG and CG libraries contained almost 10 times less cbh1 clones, which indicated that the abundant transcript was successfully normalized. Colony-hybridization of the SC library showed very low occurrence of cbh1 (only 0.1% of cbh1 clones) indicating an efficient subtraction of this abundant transcript when performing SSH with cell populations both expressing high levels of cbh1.

The cDNA clones from approximately 360 randomly picked colonies were purified by rolling circle amplification (RCA) (Dean et al., 2001, *Genome Res.* 11: 1095-1099) and analyzed by DNA sequencing (70 from Reaction 1, 96 from Reaction 2, and 192 from Reaction 3). Clustering of the sequences using Transcript Assembler™ software showed that each pool contained a high percentage of non-redundant clones: 76% for reaction 1, 90% for reaction 2, and 67% for reaction 3. In addition, the contigs (overlapping sequences of the same cDNA) identified in this analysis contained on the average only two sequences. Collectively, these observations suggested that efficient normalization of the libraries was achieved during the SSH reactions, yielding a low level of redundancy in the corresponding cDNA libraries.

Example 7

Identification of Differentially Expressed cDNAs Using Microarrays

Plasmid DNA samples from 3608 colonies representing the three SSH cDNA libraries (1152 clones each from SG and SC libraries, and 1304 clones from the CG library) were prepared using rolling-circle amplification (RCA). RCA (Dean et al., 2001, supra) of plasmid DNA from frozen cells was done using TempiPhi™ reagents (Amersham, Arlington Heights, Ill.). The amplified cDNA clones were diluted to a concentration of 100-400 ng/µl in 3×SSC and spotted from 384-well plates onto poly-L-lysine coated glass microscope slides using equipment and methods that were described previously (Eisen and Brown, 1999, *Methods Enzymol.* 303: 179-205). Several control DNAs were included as well: cbh1, cbh2, egl1, egl2, serine hydroxymethyl transferase cDNA, γ-actin, and 28S rDNA.

Fluorescent probes were prepared by reverse transcription of poly(A)$^+$ RNA, incorporating aminoallyl-dUTP into first strand cDNA (Berka et al., 2003, *Proc. Nat Acad. Sci. USA* 100: 5682-5687). The amino-cDNA products were subsequently labeled by direct coupling to either Cy3 or Cy5 monofunctional reactive dyes (Amersham, Arlington Heights, Ill.) and purified as described previously (Berka et al., 2003, supra). In all cases, cDNA from cells grown on glucose was used as the control (Cy3 label), and cDNA from cells grown on cellulose or PCS was labeled with Cy5. Cy3 and Cy5 labeled probes were combined, purified using a QIAquick PCR Purification Kit (QIAGEN, Valencia, Calif.) and dried under vacuum, resuspended in 15.5 µl of water, and combined with the following: 3.6 µl of 20×SSC, 2.5 µl of 250 mM HEPES (pH 7.0), 1.8 µl of poly-dA (500 µg/ml), and 0.54 µl of 10% SDS. Before hybridization, the solution was filtered with a 0.22 µm filter, heated to 95° C. for 2 minutes, and cooled to room temperature.

The fluorescently labeled cDNAs were applied to microarrays under cover glasses, placed in a humidified chamber, and incubated at 63° C. overnight (15-16 hours). Before scanning, the arrays were washed consecutively in 1×SSC with 0.03% SDS, 0.2×SSC, and 0.05×SSC and centrifuged for 2 minutes at 500 rpm to remove excess liquid. Microarray slides were imaged using an Axon Gene-Pix® 4000B Scanner (Axon Instruments, Union City, Calif.), and the fluorescence signals for microarray spots were quantified using GenePix® Pro 5.0 software (Axon Instruments). PMT voltages were adjusted during image collection such that the average ratio of fluorescence intensities for the entire array was approximately 1.0. The S+ ArrayAnalyzer 2.0 microarray analysis software (Insightful Corporation, Seattle, Wash.) was used for analyzing of the microarray data. Raw fluorescence intensity values were normalized using the loess function and differential expression analysis was performed using the LPE test. Those spots that were statistically significant (P<0.1) in the LPE test and for which change in the Cy5:Cy3 intensity ratios were greater than 2.0 were chosen for DNA sequencing analysis.

From the 3608 clones that were screened, 728 cDNAs were found to be differentially expressed in technical replicates with differences in Cy5:Cy3 intensity ratios≧2.0. This represented a substantial fraction of differentially expressed genes in the SSH libraries (19%) compared to 0.7% found by microarray-based screening of 25,000 random clones from a *Trichoderma reesei* genomic DNA library (not shown). The distribution of biomass-induced genes among three SSH cDNA libraries is shown in Table 3.

TABLE 3

Biomass-induced cDNAs from subtractive (SSH) libraries

| Library | Number screened | Cellulose/PCS-Induced cDNAs |
|---|---|---|
| PCS minus glucose (SG) | 1152 | 209 |
| Cellulose minus glucose (CG) | 1332 | 429 |
| PCS minus cellulose (SC) | 1152 | 90 |
| TOTAL | 3840 | 728 |

Example 8

DNA Sequencing and Analysis of Nucleotide Sequence Data of the *Trichoderma reesei* EST, Genomic, and SSH Libraries DNA sequencing of the *Trichoderma reesei* ESTs and SSH clones was conducted with a capillary array sequencer ABI PRISM 3700 DNA Analyzer (Applied Biosystems, Inc., Foster City, Calif.) using ABI-Prism BigDye terminator chemistry (Applied Biosystems, Inc., Foster City, Calif.) and standard M13 forward and reverse primers. Vector sequence and low quality sequence were removed with Phred and crossmatch (University of Washington, Seattle, Wash.). The sequences were assembled with Phrap (University of Washington, Seattle, Wash.). The assembled sequences and singletons were searched with BLAST (Altschul, et al., 1997, *Nucleic Acids Res.* 25: 3389-3402.) against PIR-NREF, a comprehensive database containing non-redundant protein sequences from PIR-PSD, Swiss-Prot, TrEMBL, RefSeq, GenPept, and PDB.

The sequences of the *Trichoderma reesei* ESTs and SSH dones are designated SEQ ID NOs. 1-1188. An "N" in a nucleic acid sequence means that the nucleotide is an A, C, G, or T. SEQ ID NOs: 1-24 are the ESTs and SEQ ID NOs: 25-1188 are the SSH clones.

The ESTs and SSH clones were compared by means of computer algorithms for homologies to the content of individual families. All sequences from a given family were used individually as a query to search a database of EST sequences of the invention using a number of different homology search algorithms like FASTA and BLAST (W. R. Pearson, 1990. Rapid and Sensitive Sequence Comparison with FASTP and FASTA, *Methods in Enzymology* 183: 63-98; and Altschul, Stephen F., Warren Gish, Webb Miller, Eugene W. Myers, and David J. Lipman, 1990, Basic local alignment search tool, *Journal of Molecular Biology* 15: 403-10). A distinct hit to a sequence of a given family predicted the particular EST or SSH clone sequence to encode a protein of that family. Using this method, part of the EST and SSH clone sequences listed in Table 4 were shown to belong to distinct enzyme families.

TABLE 4

Function Description of ESTs and SSH clones

| SEQ ID NO. | Description | PIR Accession Number |
|---|---|---|
| 1 | hypothetical protein FG05562.1 [*Gibberella zeae*] | NF01711769 |
| 3 | hypothetical protein FG00742.1 [*Gibberella zeae*] | NF01710516 |
| 4 | hypothetical protein FG01373.1 [*Gibberella zeae*] | NF01713147 |
| 5 | hypothetical protein FG07555.1 [*Gibberella zeae*] | NF01716785 |
| 6 | predicted protein [*Magnaporthe grisea*] | NF01573568 |
| 7 | hypothetical protein FG08771.1 [*Gibberella zeae*] | NF01710529 |
| 8 | hypothetical protein FG07461.1 [*Gibberella zeae*] | NF01712722 |
| 9 | hypothetical protein FG01855.1 [*Gibberella zeae*] | NF01708666 |
| 12 | hypothetical protein FG01513.1 [*Gibberella zeae*] | NF01708403 |
| 13 | Glucan 1,3 beta-glucosidase-like protein | NF00186100 |
| 14 | hypothetical protein FG06214.1 [*Gibberella zeae*] | NF01708590 |
| 15 | Cyclophilin-RNA interacting protein (EC 5.2.1.8) | NF00948523 |
| 20 | hypothetical protein FG07072.1 [*Gibberella zeae*] | NF01707147 |
| 21 | hypothetical protein FG01462.1 [*Gibberella zeae*] | NF01716821 |
| 22 | hypothetical protein FG09663.1 [*Gibberella zeae*] | NF01712777 |
| 23 | hypothetical protein FG02234.1 [*Gibberella zeae*] | NF01714687 |
| 24 | hypothetical protein FG00711.1 [*Gibberella zeae*] | NF01711861 |
| 26 | Hypothetical protein [*Neurospora crassa*] | NF01483858 |
| 29 | conserved hypothetical protein [*Gibberella zeae*] | NF01709003 |
| 30 | conserved hypothetical protein [*Gibberella zeae*] | NF01708228 |
| 31 | hypothetical protein MG01153.4 [*Magnaporthe grisea*] | NF01578120 |
| 32 | hypothetical protein FG09234.1 [*Gibberella zeae*] | NF01708819 |
| 33 | Cip2 [*Hypocrea jecorina*] | NF01379722 |
| 35 | hypothetical protein FG02467.1 [*Gibberella zeae*] | NF01714575 |
| 36 | hypothetical protein MG07201.4 [*Magnaporthe grisea*] | NF01578621 |
| 37 | hypothetical protein FG08610.1 [*Gibberella zeae*] | NF01706364 |
| 38 | HEX1 [*Hypocrea jecorina*] | NF01538586 |
| 39 | 60S ribosomal protein L12 [*Neurospora crassa*] | NF00649304 |
| 42 | Exopolygalacturonase PGX1 [*Fusarium oxysporum*] | NF00755681 |
| 43 | hypothetical protein FG05845.1 [*Gibberella zeae*] | NF01708916 |
| 50 | hypothetical protein FG10259.1 [*Gibberella zeae*] | NF01713550 |
| 51 | Hypothetical protein [*Neurospora crassa*] | NF01489009 |
| 52 | Predicted protein [*Neurospora crassa*] | NF01483451 |
| 53 | hypothetical protein UM05244.1 [*Ustilago maydis*] | NF01814929 |
| 54 | hypothetical protein UM05244.1 [*Ustilago maydis*] | NF01814929 |
| 55 | hypothetical protein UM05244.1 [*Ustilago maydis*] | NF01814929 |
| 56 | Putative senescence-associated protein (Fragment) [*Pisum sativum*] | NF00726461 |
| 57 | Putative senescence-associated protein (Fragment) [*Pyrus communis*] | NF01555598 |
| 58 | hypothetical protein UM05244.1 [*Ustilago maydis*] | NF01814929 |
| 59 | predicted protein [*Gibberella zeae*] | NF01714387 |
| 61 | Hypothetical protein [*Neurospora crassa*] | NF01486230 |
| 63 | Probable 26s proteasome p44.5 protein [*Neurospora crassa*] | NF00647520 |
| 65 | hypothetical protein FG08366.1 [*Gibberella zeae*] | NF01708463 |
| 66 | hypothetical protein FG09004.1 [*Gibberella zeae*] | NF01714213 |
| 70 | hypothetical protein FG08493.1 [*Gibberella zeae*] | NF01708515 |
| 71 | Endoglucanase III [*Trichoderma viride*] | NF01407726 |
| 72 | Endoglucanase III [*Trichoderma viride*] | NF01407726 |
| 73 | Endoglucanase III [*Trichoderma viride*] | NF01407726 |
| 74 | Hypothetical protein [*Neurospora crassa*] | NF01487792 |
| 76 | hypothetical protein FG05177.1 [*Gibberella zeae*] | NF01712231 |
| 78 | hypothetical protein FG01986.1 [*Gibberella zeae*] | NF01711586 |
| 79 | predicted protein [*Emericella nidulans*] | NF01788176 |
| 82 | Cellobiohydrolase II [*Trichoderma viride*] | NF01470256 |
| 83 | Cellobiohydrolase II [*Trichoderma viride*] | NF01470256 |
| 84 | Cellobiohydrolase II [*Trichoderma viride*] | NF01470256 |
| 85 | Cellobiohydrolase II [*Trichoderma viride*] | NF01470256 |
| 86 | hypothetical protein FG06119.1 [*Gibberella zeae*] | NF01706228 |
| 87 | Strain NRRL Y-1140 chromosome D of strain NRRL Y-1140 of Kluyveromyces lactis (Fragment) [*Kluyveromyces lactis*] | NF01870375 |
| 88 | Strain NRRL Y-1140 chromosome D of strain NRRL Y-1140 of Kluyveromyces lactis (Fragment) [*Kluyveromyces lactis*] | NF01870375 |
| 94 | Similar to tr|Q96WT5 *Aspergillus oryzae* Maltose permease [*Debaryomyces hansenii*] | NF01905886 |
| 95 | Similar to tr|Q96WT5 *Aspergillus oryzae* Maltose permease [*Debaryomyces hansenii*] | NF01905886 |
| 96 | hypothetical protein FG00070.1 [*Gibberella zeae*] | NF01714480 |
| 97 | Endoglucanase III [*Trichoderma viride*] | NF01407726 |
| 98 | Endoglucanase III [*Trichoderma viride*] | NF01407726 |
| 100 | hypothetical protein FG05066.1 [*Gibberella zeae*] | NF01714926 |
| 101 | conserved hypothetical protein [*Gibberella zeae*] | NF01713888 |
| 102 | hypothetical protein FG03260.1 [*Gibberella zeae*] | NF01708766 |
| 103 | hypothetical protein MG04400.4 [*Magnaporthe grisea*] | NF01582694 |

TABLE 4-continued

Function Description of ESTs and SSH clones

| SEQ ID NO. | Description | PIR Accession Number |
|---|---|---|
| 105 | hypothetical protein FG07945.1 [*Gibberella zeae*] | NF01714580 |
| 106 | Swollenin precursor [*Hypocrea jecorina*] | NF00494342 |
| 107 | Swollenin precursor [*Hypocrea jecorina*] | NF00494342 |
| 108 | Swollenin precursor [*Hypocrea jecorina*] | NF00494342 |
| 109 | Swollenin precursor [*Hypocrea jecorina*] | NF00494342 |
| 111 | hypothetical protein FG06718.1 [*Gibberella zeae*] | NF01706773 |
| 112 | COI i1 protein [*Agrocybe aegerita*] | NF00746529 |
| 114 | hypothetical protein FG06516.1 [*Gibberella zeae*] | NF01713352 |
| 117 | hypothetical protein FG06239.1 [*Gibberella zeae*] | NF01707463 |
| 122 | hypothetical protein FG04149.1 [*Gibberella zeae*] | NF01708688 |
| 124 | hypothetical protein AN6831.2 [*Emericella nidulans*] | NF01781110 |
| 125 | hypothetical protein AN6831.2 [*Emericella nidulans*] | NF01781110 |
| 134 | hypothetical protein MG06524.4 [*Magnaporthe grisea*] | NF01576755 |
| 135 | hypothetical protein FG10921.1 [*Gibberella zeae*] | NF01708328 |
| 137 | hypothetical protein AN7772.2 [*Emericella nidulans*] | NF01783212 |
| 138 | hypothetical protein AN6831.2 [*Emericella nidulans*] | NF01781110 |
| 139 | hypothetical protein AN6831.2 [*Emericella nidulans*] | NF01781110 |
| 140 | hypothetical protein AN6831.2 [*Emericella nidulans*] | NF01781110 |
| 141 | hypothetical protein AN6831.2 [*Emericella nidulans*] | NF01781110 |
| 145 | Hypothetical protein [*Neurospora crassa*] | NF01485496 |
| 146 | hypothetical protein FG03028.1 [*Gibberella zeae*] | NF01714672 |
| 147 | Cip2 [*Hypocrea jecorina*] | NF01379722 |
| 148 | hypothetical protein FG03028.1 [*Gibberella zeae*] | NF01714672 |
| 150 | hypothetical protein FG10320.1 [*Gibberella zeae*] | NF01708223 |
| 151 | hypothetical protein FG05572.1 [*Gibberella zeae*] | NF01707831 |
| 156 | hypothetical protein FG03424.1 [*Gibberella zeae*] | NF01713250 |
| 157 | hypothetical protein FG03424.1 [*Gibberella zeae*] | NF01713250 |
| 158 | Polyketide synthase [*Cochliobolus heterostrophus*] | NF01679256 |
| 160 | hypothetical protein FG06645.1 [*Gibberella zeae*] | NF01710877 |
| 162 | hypothetical protein FG04880.1 [*Gibberella zeae*] | NF01711500 |
| 163 | Exoglucanase I precursor (EC 3.2.1.91) (Exocellobiohydrolase I) (CBHI) (1,4-beta-cellobiohydrolase) [*Hypocrea ceramica*] | NF00769949 |
| 164 | Exoglucanase I precursor (EC 3.2.1.91) (Exocellobiohydrolase I) (CBHI) (1,4-beta-cellobiohydrolase) [*Hypocrea ceramica*] | NF00769949 |
| 166 | Tripeptidylpeptidase 2 precursor [*Aspergillus fumigatus*] | NF01739585 |
| 168 | hypothetical protein FG00916.1 [*Gibberella zeae*] | NF01707379 |
| 170 | hypothetical protein FG01868.1 [*Gibberella zeae*] | NF01710654 |
| 171 | Hypothetical protein B24M22.120 [*Neurospora crassa*] | NF00822527 |
| 172 | CISY_NEUCR Citrate synthase, mitochondrial precursor [*Gibberella zeae*] | NF01709377 |
| 173 | Endo-1,4-beta-xylanase 2 precursor (EC 3.2.1.8) (Xylanase 2) (1,4-beta-D-xylan xylanohydrolase 2) [*Hypocrea jecorina*] | NF00494353 |
| 174 | Endo-1,4-beta-xylanase (EC 3.2.1.8) IIA [*Trichoderma viride*] | NF00756627 |
| 176 | Hemolysin [*Acanthamoeba polyphaga*] | NF00003921 |
| 178 | PCZA361.14 [*Amycolatopsis orientalis*] | NF00428903 |
| 179 | PCZA361.14 [*Amycolatopsis orientalis*] | NF00428903 |
| 180 | hypothetical protein AN6396.2 [*Emericella nidulans*] | NF01784171 |
| 181 | hypothetical protein FG08669.1 [*Gibberella zeae*] | NF01709222 |
| 183 | Cip1 [*Hypocrea jecorina*] | NF01379724 |
| 184 | Cellobiohydrolase I [*Trichoderma viride*] | NF01470257 |
| 185 | ADT_NEUCR ADP,ATP CARRIER PROTEIN (ADP/ATP TRANSLOCASE) (ADENINE NUCLEOTIDE TRANSLOCATOR) (ANT) [*Gibberella zeae*] | NF01707425 |
| 188 | Hypothetical protein (Related to aldose 1-epimerase) [*Neurospora crassa*] | NF01490813 |
| 193 | 40S ribosomal protein S15 (S12) [*Podospora anserina*] | NF00649664 |
| 194 | hypothetical protein FG05134.1 [*Gibberella zeae*] | NF01714637 |
| 195 | hypothetical protein FG01081.1 [*Gibberella zeae*] | NF01706654 |
| 197 | hypothetical protein FG05399.1 [*Gibberella zeae*] | NF01711065 |
| 199 | hypothetical protein FG01106.1 [*Gibberella zeae*] | NF01705903 |
| 200 | Related to phenol 2-monooxygenase [*Neurospora crassa*] | NF00649064 |
| 204 | Abf2 [*Hypocrea jecorina*] | NF01379727 |
| 205 | Abf2 [*Hypocrea jecorina*] | NF01379727 |
| 206 | hypothetical protein FG08587.1 [*Gibberella zeae*] | NF01711855 |
| 211 | hypothetical protein FG09286.1 [*Gibberella zeae*] | NF01714081 |
| 212 | hypothetical protein FG00248.1 [*Gibberella zeae*] | NF01713168 |
| 214 | hypothetical protein FG04512.1 [*Gibberella zeae*] | NF01714942 |
| 215 | Cellobiohydrolase I [*Trichoderma viride*] | NF01470257 |
| 216 | hypothetical protein AN1677.2 [*Emericella nidulans*] | NF01784923 |
| 217 | Cellobiohydrolase I [*Trichoderma viride*] | NF01470257 |
| 221 | Endoglucanase III [*Trichoderma viride*] | NF01407726 |
| 222 | Endoglucanase III [*Trichoderma viride*] | NF01407726 |
| 223 | IntI (Fragment) [*Citrobacter freundii*] | NF00904695 |
| 224 | Acetyl Xylan Esterase [*Hypocrea jecorina*] | NF00494390 |

TABLE 4-continued

Function Description of ESTs and SSH clones

| SEQ ID NO. | Description | PIR Accession Number |
|---|---|---|
| 225 | Acetylxylan esterase precursor (EC 3.1.1.72) [*Hypocrea jecorina*] | NF00494333 |
| 226 | Acetylxylan esterase precursor (EC 3.1.1.72) [*Hypocrea jecorina*] | NF00494333 |
| 227 | D-xylose reductase (EC 1.1.1.9) [*Hypocrea jecorina*] | NF01282548 |
| 228 | conserved hypothetical protein [*Gibberella zeae*] | NF01706258 |
| 229 | Xylanase III [*Hypocrea jecorina*] | NF00494389 |
| 230 | HSP70 [*Hypocrea jecorina*] | NF01324889 |
| 231 | HSP70 [*Hypocrea jecorina*] | NF01324889 |
| 233 | Neuronal calcium sensor 1 [*Magnaporthe grisea*] | NF00946519 |
| 234 | QI74 protein [*Hypocrea lixii*] | NF00756616 |
| 236 | CISY_NEUCR Citrate synthase, mitochondrial precursor [*Gibberella zeae*] | NF01709377 |
| 237 | Hypothetical protein [*Neurospora crassa*] | NF01483858 |
| 238 | Cip2 [*Hypocrea jecorina*] | NF01379722 |
| 240 | Bete-glucosidase [*Hypocrea jecorina*] | NF00494329 |
| 241 | Acid phosphatase (Fragment) [*Aspergillus niger*] | NF00626490 |
| 242 | hypothetical protein FG03882.1 [*Gibberella zeae*] | NF01708914 |
| 243 | hypothetical protein FG10320.1 [*Gibberella zeae*] | NF01708223 |
| 244 | Endo-1,4-beta-xylanase 1 precursor (EC 3.2.1.8) (Xylanase 1) (1,4-beta-D-xylan xylanohydrolase 1) [*Hypocrea jecorina*] | NF00494326 |
| 245 | Endo-1,4-beta-xylanase 1 precursor (EC 3.2.1.8) (Xylanase 1) (1,4-beta-D-xylan xylanohydrolase 1) [*Hypocrea jecorina*] | NF00494326 |
| 246 | Endo-1,4-beta-xylanase 1 precursor (EC 3.2.1.8) (Xylanase 1) (1,4-beta-D-xylan xylanohydrolase 1) [*Hypocrea jecorina*] | NF00494326 |
| 247 | Endo-1,4-beta-xylanase 1 precursor (EC 3.2.1.8) (Xylanase 1) (1,4-beta-D-xylan xylanohydrolase 1) [*Hypocrea jecorina*] | NF00494326 |
| 248 | hypothetical protein AN3876.2 [*Emericella nidulans*] | NF01785990 |
| 249 | Elongation factor 1-alpha (EF-1-alpha) [*Hypocrea jecorina*] | NF00494402 |
| 253 | hypothetical protein FG02628.1 [*Gibberella zeae*] | NF01706121 |
| 254 | Hypothetical protein [*Neurospora crassa*] | NF01487111 |
| 257 | Polyubiquitin [*Tuber borchii*] | NF00176514 |
| 259 | hypothetical protein FG07555.1 [*Gibberella zeae*] | NF01716785 |
| 260 | hypothetical protein MG00775.4 [*Magnaporthe grisea*] | NF01577948 |
| 261 | RRNA intron-encoded homing endonuclease (Fragment) [*Oryza sativa*] | NF00253537 |
| 262 | hypothetical protein FG08530.1 [*Gibberella zeae*] | NF01710746 |
| 264 | Predicted protein [*Neurospora crassa*] | NF01485930 |
| 266 | hypothetical protein FG07925.1 [*Gibberella zeae*] | NF01706457 |
| 269 | Repressible high-affinity phosphate permease [*Neurospora crassa*] | NF00648186 |
| 270 | Heat shock protein 80 [*Neurospora crassa*] | NF00647533 |
| 272 | Probable hydroxyacylglutathione hydrolase [*Neurospora crassa*] | NF00648544 |
| 273 | Hydrophobin II precursor (HFBII) [*Hypocrea jecorina*] | NF00494356 |
| 274 | Heat shock protein 90 homolog (Suppressor of vegetative incompatibility MOD-E) [*Podospora anserina*] | NF00649581 |
| 275 | Probable maturase [*Hypocrea jecorina*] | NF00873684 |
| 278 | hypothetical protein FG00553.1 [*Gibberella zeae*] | NF01709063 |
| 279 | hypothetical protein FG09864.1 [*Gibberella zeae*] | NF01713126 |
| 283 | hypothetical protein FG06097.1 [*Gibberella zeae*] | NF01712468 |
| 284 | hypothetical protein MG00971.4 [*Magnaporthe grisea*] | NF01574249 |
| 285 | hypothetical protein FG05259.1 [*Gibberella zeae*] | NF01711539 |
| 287 | hypothetical protein FG09906.1 [*Gibberella zeae*] | NF01708997 |
| 288 | Glycerol-3-phosphate dehydrogenase (NAD+) (EC 1.1.1.8) [*Trichoderma atroviride*] | NF01732006 |
| 290 | GR78_NEUCR 78 KDA GLUCOSE-REGULATED PROTEIN HOMOLOG PRECURSOR (GRP 78) (IMMUNOGLOBULIN HEAVY CHAIN BINDING PROTEIN HOMOLOG) (BIP) [*Gibberella zeae*] | NF01712405 |
| 291 | hypothetical protein MG06267.4 [*Magnaporthe grisea*] | NF01580275 |
| 292 | hypothetical protein AN6154.2 [*Emericella nidulans*] | NF01786374 |
| 293 | hypothetical protein FG07180.1 [*Gibberella zeae*] | NF01713398 |
| 294 | Similar to sp|P16474 *Saccharomyces cerevisiae* YJL034w KAR2 nuclear fusion protein [*Debaryomyces hansenii*] | NF01905417 |
| 299 | Hypothetical protein [*Neurospora crassa*] | NF01490079 |
| 300 | hypothetical protein FG02697.1 [*Gibberella zeae*] | NF01712949 |
| 301 | hypothetical protein FG09164.1 [*Gibberella zeae*] | NF01713596 |
| 304 | Hypothetical protein [*Neurospora crassa*] | NF01484547 |
| 305 | hypothetical protein FG04985.1 [*Gibberella zeae*] | NF01706601 |
| 306 | hypothetical protein FG07382.1 [*Gibberella zeae*] | NF01708643 |
| 311 | hypothetical protein FG08587.1 [*Gibberella zeae*] | NF01711855 |
| 312 | hypothetical protein FG08587.1 [*Gibberella zeae*] | NF01711855 |
| 313 | hypothetical protein AN8186.2 [*Emericella nidulans*] | NF01787561 |
| 316 | hypothetical protein FG04237.1 [*Gibberella zeae*] | NF01709332 |
| 319 | hypothetical protein FG06675.1 [*Gibberella zeae*] | NF01706901 |
| 321 | Serine/threonine kinase IRE1 [*Hypocrea jecorina*] | NF01379730 |
| 323 | hypothetical protein AN7772.2 [*Emericella nidulans*] | NF01783212 |

TABLE 4-continued

Function Description of ESTs and SSH clones

| SEQ ID NO. | Description | PIR Accession Number |
|---|---|---|
| 324 | hypothetical protein FG05252.1 [*Gibberella zeae*] | NF01709811 |
| 332 | hypothetical protein FG06956.1 [*Gibberella zeae*] | NF01715297 |
| 333 | hypothetical protein FG09403.1 [*Gibberella zeae*] | NF01708030 |
| 334 | hypothetical protein FG09403.1 [*Gibberella zeae*] | NF01708030 |
| 335 | Swollenin precursor [*Hypocrea jecorina*] | NF00494342 |
| 336 | Cel61b [*Hypocrea jecorina*] | NF01379731 |
| 338 | PCZA361.14 [*Amycolatopsis orientalis*] | NF00428903 |
| 339 | hypothetical protein FG02725.1 [*Gibberella zeae*] | NF01714298 |
| 341 | Class V chitinase (Endochitinase class V) [*Hypocrea virens*] | NF00939353 |
| 343 | conserved hypothetical protein [*Gibberella zeae*] | NF01712388 |
| 344 | conserved hypothetical protein [*Gibberella zeae*] | NF01716160 |
| 345 | Hypothetical protein [*Neurospora crassa*] | NF01490310 |
| 347 | Hypothetical protein ART1 [*Saccharomyces cerevisiae*] | NF00955424 |
| 348 | hypothetical protein FG00765.1 [*Gibberella zeae*] | NF01712921 |
| 350 | hypothetical protein AN8789.2 [*Emericella nidulans*] | NF01780447 |
| 351 | hypothetical protein FG10027.1 [*Gibberella zeae*] | NF01714529 |
| 355 | hypothetical protein FG05213.1 [*Gibberella zeae*] | NF01708686 |
| 357 | Endo-1,4-beta-xylanase 1 precursor (EC 3.2.1.8) (Xylanase 1) (1,4-beta-D-xylan xylanohydrolase 1) [*Hypocrea jecorina*] | NF00494326 |
| 359 | hypothetical protein FG10027.1 [*Gibberella zeae*] | NF01714529 |
| 360 | hypothetical protein FG10027.1 [*Gibberella zeae*] | NF01714529 |
| 361 | hypothetical protein FG06945.1 [*Gibberella zeae*] | NF01712739 |
| 363 | Swollenin precursor [*Hypocrea jecorina*] | NF00494342 |
| 364 | Endo-1,4-B-D-Mannanase [*Hypocrea jecorina*] | NF00494391 |
| 367 | Hypothetical protein (Related to EDE1 protein) [*Neurospora crassa*] | NF01486195 |
| 369 | hypothetical protein FG01191.1 [*Gibberella zeae*] | NF01708050 |
| 370 | hypothetical protein AN1577.2 [*Emericella nidulans*] | NF01780487 |
| 371 | hypothetical protein AN1577.2 [*Emericella nidulans*] | NF01780487 |
| 373 | Cip1 [*Hypocrea jecorina*] | NF01379724 |
| 374 | hypothetical protein FG11637.1 [*Gibberella zeae*] | NF01712269 |
| 376 | Cel61b [*Hypocrea jecorina*] | NF01379731 |
| 377 | hypothetical protein FG05762.1 [*Gibberella zeae*] | NF01709497 |
| 380 | hypothetical protein FG06113.1 [*Gibberella zeae*] | NF01706743 |
| 382 | NADH-ubiquinone oxidoreductase chain 1 [*Hypocrea jecorina*] | NF00873695 |
| 383 | Hypothetical protein (Probable prefoldin subunit 5) [*Neurospora crassa*] | NF01487302 |
| 384 | Endo-1,4-beta-xylanase 1 precursor (EC 3.2.1.8) (Xylanase 1) (1,4-beta-D-xylan xylanohydrolase 1) [*Hypocrea jecorina*] | NF00494326 |
| 385 | Acetylxylan esterase precursor (EC 3.1.1.72) [*Hypocrea jecorina*] | NF00494333 |
| 386 | Acetylxylan esterase precursor (EC 3.1.1.72) [*Hypocrea jecorina*] | NF00494333 |
| 387 | hypothetical protein FG07476.1 [*Gibberella zeae*] | NF01706432 |
| 388 | Beta-xylosidase precursor (EC 3.2.1.37) [*Hypocrea jecorina*] | NF00494350 |
| 389 | hypothetical protein FG03723.1 [*Gibberella zeae*] | NF01713175 |
| 391 | hypothetical protein FG09287.1 [*Gibberella zeae*] | NF01713279 |
| 392 | Hypothetical protein [*Neurospora crassa*] | NF01486153 |
| 393 | hypothetical protein FG10726.1 [*Gibberella zeae*] | NF01706641 |
| 394 | hypothetical protein FG08743.1 [*Gibberella zeae*] | NF01707411 |
| 395 | hypothetical protein FG02328.1 [*Gibberella zeae*] | NF01708392 |
| 397 | Putative serine hydroxymethyltransferase, mitochondrial precursor (EC 2.1.2.1) (Serine methylase) (Glycine hydroxymethyltransferase) (SHMT) [*Neurospora crassa*] | NF01487447 |
| 398 | hypothetical protein MG05941.4 [*Magnaporthe grisea*] | NF01580292 |
| 400 | hypothetical protein FG09129.1 [*Gibberella zeae*] | NF01710763 |
| 402 | hypothetical protein FG08610.1 [*Gibberella zeae*] | NF01706364 |
| 404 | hypothetical protein FG05089.1 [*Gibberella zeae*] | NF01713808 |
| 406 | Related to glucosidase II, alpha subunit [*Neurospora crassa*] | NF01053974 |
| 408 | Ribosomal protein S5 [*Hypocrea jecorina*] | NF00873692 |
| 409 | Meiosis-specific topoisomerase Spo11 [*Sordaria macrospora*] | NF01466214 |
| 410 | Endo-1,4-B-D-Mannanase [*Hypocrea jecorina*] | NF00494391 |
| 411 | Endoglucanase I [*Trichoderma viride*] | NF01407727 |
| 413 | Strain NRRL Y-1140 chromosome A of strain NRRL Y-1140 of Kluyveromyces lactis [*Kluyveromyces lactis*] | NF01870073 |
| 414 | Cel1b [*Hypocrea jecorina*] | NF01379721 |
| 416 | hypothetical protein FG06115.1 [*Gibberella zeae*] | NF01706331 |
| 417 | hypothetical protein FG09775.1 [*Gibberella zeae*] | NF01707684 |
| 420 | hypothetical protein FG01216.1 [*Gibberella zeae*] | NF01711762 |
| 423 | hypothetical protein UM05244.1 [*Ustilago maydis*] | NF01814929 |
| 424 | predicted protein [*Emericella nidulans*] | NF01784780 |
| 426 | Similarities with sp|Q9Y071 Periplaneta americana Putative transcription factor [*Kluyveromyces lactis*] | NF01867546 |
| 427 | predicted protein [*Emericella nidulans*] | NF01784780 |
| 428 | hypothetical protein MG11015.4 [*Magnaporthe grisea*] | NF01575169 |
| 439 | Endoglucanase III [*Trichoderma viride*] | NF01407726 |

TABLE 4-continued

Function Description of ESTs and SSH clones

| SEQ ID NO. | Description | PIR Accession Number |
|---|---|---|
| 440 | Cellobiohydrolase II [*Trichoderma viride*] | NF01470256 |
| 441 | Cellobiohydrolase II [*Trichoderma viride*] | NF01470256 |
| 442 | Strain NRRL Y-1140 chromosome D of strain NRRL Y-1140 of Kluyveromyces lactis (Fragment) [*Kluyveromyces lactis*] | NF01867244 |
| 443 | Strain NRRL Y-1140 chromosome D of strain NRRL Y-1140 of Kluyveromyces lactis (Fragment) [*Kluyveromyces lactis*] | NF01870375 |
| 444 | Strain NRRL Y-1140 chromosome D of strain NRRL Y-1140 of Kluyveromyces lactis (Fragment) [*Kluyveromyces lactis*] | NF01870375 |
| 447 | hypothetical protein FG08841.1 [*Gibberella zeae*] | NF01706464 |
| 450 | hypothetical protein MG10519.4 [*Magnaporthe grisea*] | NF01577826 |
| 452 | Endoglucanase III [*Trichoderma viride*] | NF01407726 |
| 453 | hypothetical protein FG03260.1 [*Gibberella zeae*] | NF01708766 |
| 454 | Swollenin precursor [*Hypocrea jecorina*] | NF00494342 |
| 455 | Swollenin precursor [*Hypocrea jecorina*] | NF00494342 |
| 456 | Swollenin precursor [*Hypocrea jecorina*] | NF00494342 |
| 457 | Swollenin precursor [*Hypocrea jecorina*] | NF00494342 |
| 463 | hypothetical protein AN6831.2 [*Emericella nidulans*] | NF01781110 |
| 464 | hypothetical protein AN6831.2 [*Emericella nidulans*] | NF01781110 |
| 466 | hypothetical protein FG03028.1 [*Gibberella zeae*] | NF01714672 |
| 468 | hypothetical protein FG03028.1 [*Gibberella zeae*] | NF01714672 |
| 470 | Endoglucanase III [*Trichoderma viride*] | NF01407726 |
| 473 | Endoglucanase IV precursor (EC 3.2.1.4) (Endo-1,4-beta-glucanase IV) (Cellulase IV) (EGIV) [*Hypocrea jecorina*] | NF00494352 |
| 474 | Endoglucanase IV precursor (EC 3.2.1.4) (Endo-1,4-beta-glucanase IV) (Cellulase IV) (EGIV) [*Hypocrea jecorina*] | NF00494352 |
| 475 | conserved hypothetical protein [*Gibberella zeae*] | NF01705663 |
| 476 | conserved hypothetical protein [*Gibberella zeae*] | NF01705663 |
| 478 | Exoglucanase I precursor (EC 3.2.1.91) (Exocellobiohydrolase I) (CBHI) (1,4-beta-cellobiohydrolase) [*Hypocrea ceramica*] | NF00769949 |
| 479 | Exoglucanase I precursor (EC 3.2.1.91) (Exocellobiohydrolase I) (CBHI) (1,4-beta-cellobiohydrolase) [*Hypocrea ceramica*] | NF00769949 |
| 480 | Endoglucanase III [*Trichoderma viride*] | NF01407726 |
| 481 | Tripeptidylpeptidase 2 precursor [*Aspergillus fumigatus*] | NF01739585 |
| 484 | hypothetical protein FG09306.1 [*Gibberella zeae*] | NF01716109 |
| 485 | Hypothetical protein 65E11.040 [*Neurospora crassa*] | NF00647950 |
| 486 | hypothetical protein FG03590.1 [*Gibberella zeae*] | NF01715080 |
| 487 | hypothetical protein FG03590.1 [*Gibberella zeae*] | NF01715080 |
| 490 | 40S ribosomal protein S15 (S12) [*Podospora anserina*] | NF00649664 |
| 492 | hypothetical protein FG01230.1 [*Gibberella zeae*] | NF01706327 |
| 494 | conserved hypothetical protein [*Gibberella zeae*] | NF01707560 |
| 495 | Abf2 [*Hypocrea jecorina*] | NF01379727 |
| 502 | hypothetical protein FG04512.1 [*Gibberella zeae*] | NF01714942 |
| 503 | Cellobiohydrolase I [*Trichoderma viride*] | NF01470257 |
| 504 | Cellobiohydrolase II [*Trichoderma viride*] | NF01470256 |
| 505 | Cellobiohydrolase II [*Trichoderma viride*] | NF01470256 |
| 506 | Cellobiohydrolase II [*Trichoderma viride*] | NF01470256 |
| 507 | Endoglucanase III [*Trichoderma viride*] | NF01407726 |
| 508 | Acetyl Xylan Esterase [*Hypocrea jecorina*] | NF00494390 |
| 510 | hypothetical protein FG10222.1 [*Gibberella zeae*] | NF01710342 |
| 511 | hypothetical protein FG10222.1 [*Gibberella zeae*] | NF01710342 |
| 517 | Bete-glucosidase [*Hypocrea jecorina*] | NF00494329 |
| 518 | Endo-1,4-beta-xylanase 1 precursor (EC 3.2.1.8) (Xylanase 1) (1,4-beta-D-xylan xylanohydrolase 1) [*Hypocrea jecorina*] | NF00494326 |
| 519 | Hypothetical protein [*Neurospora crassa*] | NF01487111 |
| 521 | Polyubiquitin [*Schizosaccharomyces pombe*] | NF00300425 |
| 522 | Polyubiquitin [*Gibberella pulicaris*] | NF00647182 |
| 523 | Polyubiquitin [*Schizosaccharomyces pombe*] | NF00300425 |
| 524 | hypothetical protein FG07925.1 [*Gibberella zeae*] | NF01706457 |
| 525 | hypothetical protein AN6831.2 [*Emericella nidulans*] | NF01781110 |
| 526 | Probable hydroxyacylglutathione hydrolase [*Neurospora crassa*] | NF00648544 |
| 530 | Similar to sp|P16474 Saccharomyces cerevisiae YJL034w KAR2 nuclear fusion protein [*Debaryomyces hansenii*] | NF01905417 |
| 534 | hypothetical protein FG08587.1 [*Gibberella zeae*] | NF01711855 |
| 540 | hypothetical protein MG03691.4 [*Magnaporthe grisea*] | NF01578801 |
| 542 | Cel61b [*Hypocrea jecorina*] | NF01379731 |
| 546 | Hypothetical protein ART1 [*Saccharomyces cerevisiae*] | NF00955424 |
| 550 | Apocytochrome B [*Hypocrea jecorina*] | NF00873696 |
| 551 | Intron-encoded DNA endonuclease I-AniI precursor (mRNA maturase bI1) (COB intron protein) [Contains: Truncated, nonfunctional cytochrome b; DNA endonuclease/RNA maturase I-AniI (EC 3.1.—.—)][*Emericella nidulans*] | NF00176170 |
| 552 | cellulose 1,4-beta-cellobiosidase (EC 3.2.1.91) II [*Trichoderma viride*] | NF00756633 |
| 553 | Cellobiohydrolase II [*Trichoderma viride*] | NF01470256 |

TABLE 4-continued

Function Description of ESTs and SSH clones

| SEQ ID NO. | Description | PIR Accession Number |
|---|---|---|
| 554 | Hypothetical protein [*Neurospora crassa*] | NF01490857 |
| 555 | Hypothetical protein [*Neurospora crassa*] | NF01490857 |
| 558 | Cel61b [*Hypocrea jecorina*] | NF01379731 |
| 559 | Endo-1,4-beta-xylanase 1 precursor (EC 3.2.1.8) (Xylanase 1) (1,4-beta-D-xylan xylanohydrolase 1) [*Hypocrea jecorina*] | NF00494326 |
| 560 | Endo-1,4-beta-xylanase 1 precursor (EC 3.2.1.8) (Xylanase 1) (1,4-beta-D-xylan xylanohydrolase 1) [*Hypocrea jecorina*] | NF00494326 |
| 561 | Endo-1,4-beta-xylanase 1 precursor (EC 3.2.1.8) (Xylanase 1) (1,4-beta-D-xylan xylanohydrolase 1) [*Hypocrea jecorina*] | NF00494326 |
| 562 | Endo-1,4-beta-xylanase 1 precursor (EC 3.2.1.8) (Xylanase 1) (1,4-beta-D-xylan xylanohydrolase 1) [*Hypocrea jecorina*] | NF00494326 |
| 563 | Endo-1,4-beta-xylanase 1 precursor (EC 3.2.1.8) (Xylanase 1) (1,4-beta-D-xylan xylanohydrolase 1) [*Hypocrea jecorina*] | NF00494326 |
| 566 | conserved hypothetical protein [*Gibberella zeae*] | NF01712388 |
| 567 | Cytochrome c oxidase polypeptide I [*Hypocrea jecorina*] | NF00873697 |
| 569 | Putative ABC transporter [*Mycosphaerella graminicola*] | NF00381211 |
| 570 | Similar to aryl-alcohol oxidase from *Pleurotus pulmonarius* [*Podospora anserina*] | NF01217365 |
| 573 | hypothetical protein FG04382.1 [*Gibberella zeae*] | NF01706345 |
| 577 | conserved hypothetical protein [*Gibberella zeae*] | NF01716580 |
| 578 | Hypothetical protein [*Neurospora crassa*] | NF01489642 |
| 583 | hypothetical protein FG06707.1 [*Gibberella zeae*] | NF01714193 |
| 587 | conserved hypothetical protein [*Gibberella zeae*] | NF01709891 |
| 598 | hypothetical protein MG01995.4 [*Magnaporthe grisea*] | NF01575095 |
| 601 | HEX1 [*Hypocrea jecorina*] | NF01538586 |
| 603 | hypothetical protein FG05593.1 [*Gibberella zeae*] | NF01706656 |
| 605 | Hexose transporter [*Aspergillus parasiticus*] | NF00626774 |
| 606 | hypothetical protein FG06196.1 [*Gibberella zeae*] | NF01715262 |
| 607 | hypothetical protein FG03126.1 [*Gibberella zeae*] | NF01706334 |
| 608 | hypothetical protein MG07264.4 [*Magnaporthe grisea*] | NF01573254 |
| 617 | hypothetical protein FG06108.1 [*Gibberella zeae*] | NF01713127 |
| 619 | hypothetical protein FG09495.1 [*Gibberella zeae*] | NF01717010 |
| 622 | hypothetical protein FG09966.1 [*Gibberella zeae*] | NF01714711 |
| 636 | Similar to sp|P56092 *Candida maltosa* EPD1 protein [*Debaryomyces hansenii*] | NF01906680 |
| 638 | DNA lyase [*Cordyceps militaris*] | NF01250907 |
| 639 | Endoglucanase I [*Trichoderma viride*] | NF01407727 |
| 645 | VA0D_NEUCR Vacuolar ATP synthase subunit d (V-ATPase d subunit) (Vacuolar proton pump d subunit) (V-ATPase 41 kDa subunit) [*Gibberella zeae*] | NF01716692 |
| 646 | conserved hypothetical protein [*Gibberella zeae*] | NF01707651 |
| 647 | Stress response element binding protein [*Trichoderma atroviride*] | NF01028245 |
| 648 | heat shock protein [*Aspergillus niger*] | NF01893378 |
| 649 | Hypothetical protein (Probable glucokinase) [*Neurospora crassa*] | NF01484367 |
| 650 | Glucan synthase [*Coccidioides posadasii*] | NF01745740 |
| 655 | hypothetical protein FG04237.1 [*Gibberella zeae*] | NF01709332 |
| 658 | hypothetical protein FG03821.1 [*Gibberella zeae*] | NF01712437 |
| 667 | hypothetical protein MG03494.4 [*Magnaporthe grisea*] | NF01582484 |
| 669 | hypothetical protein FG10735.1 [*Gibberella zeae*] | NF01712758 |
| 672 | Enolase (EC 4.2.1.11) (2-phosphoglycerate dehydratase) (2-phospho-D-glycerate hydro-lyase) [*Aspergillus oryzae*] | NF00626668 |
| 680 | Hypothetical protein [*Neurospora crassa*] | NF01484177 |
| 683 | Thiazole biosynthetic enzyme, mitochondrial precursor (Stress-inducible protein sti35) [*Fusarium oxysporum*] | NF00755602 |
| 684 | hypothetical protein FG09535.1 [*Gibberella zeae*] | NF01712897 |
| 685 | Histidine kinase [*Magnaporthe grisea*] | NF00213123 |
| 690 | conserved hypothetical protein [*Gibberella zeae*] | NF01715974 |
| 700 | AGL352Wp [*Eremothecium gossypii*] | NF01657112 |
| 701 | Hypothetical protein [*Neurospora crassa*] | NF01487930 |
| 702 | hypothetical protein MG00195.4 [*Magnaporthe grisea*] | NF01574164 |
| 705 | hypothetical protein AN3499.2 [*Emericella nidulans*] | NF01781700 |
| 707 | Beta-D-glucoside glucohydrolase precursor (EC 3.2.1.21) [*Hypocrea jecorina*] | NF00494358 |
| 709 | hypothetical protein FG00700.1 [*Gibberella zeae*] | NF01707186 |
| 710 | hypothetical protein MG10568.4 [*Magnaporthe grisea*] | NF01579367 |
| 715 | hypothetical protein FG09381.1 [*Gibberella zeae*] | NF01712438 |
| 719 | hypothetical protein FG01970.1 [*Gibberella zeae*] | NF01711972 |
| 722 | hypothetical protein FG10246.1 [*Gibberella zeae*] | NF01708661 |
| 723 | Hypothetical protein [*Neurospora crassa*] | NF01490566 |
| 724 | hypothetical protein MG08177.4 [*Magnaporthe grisea*] | NF01576377 |
| 726 | hypothetical protein FG09566.1 [*Gibberella zeae*] | NF01710505 |
| 728 | ATP-binding cassette transporter ABC1 [*Venturia inaequalis*] | NF00903329 |
| 730 | NADH-ubiquinone oxidoreductase chain 1 [*Hypocrea jecorina*] | NF00873695 |
| 731 | hypothetical protein MG00195.4 [*Magnaporthe grisea*] | NF01574164 |

TABLE 4-continued

Function Description of ESTs and SSH clones

| SEQ ID NO. | Description | PIR Accession Number |
|---|---|---|
| 736 | hypothetical protein AN8551.2 [*Emericella nidulans*] | NF01787890 |
| 737 | hypothetical protein FG00840.1 [*Gibberella zeae*] | NF01715067 |
| 740 | hypothetical protein FG02601.1 [*Gibberella zeae*] | NF01711773 |
| 741 | hypothetical protein FG09721.1 [*Gibberella zeae*] | NF01715057 |
| 743 | Endoglucanase I [*Trichoderma viride*] | NF01407727 |
| 748 | hypothetical protein FG00486.1 [*Gibberella zeae*] | NF01713181 |
| 761 | hypothetical protein MG03220.4 [*Magnaporthe grisea*] | NF01583628 |
| 762 | hypothetical protein FG02160.1 [*Gibberella zeae*] | NF01712582 |
| 763 | Glucan synthase [*Paracoccidioides brasiliensis*] | NF00227448 |
| 765 | EF2_NEUCR Elongation factor 2 (EF-2) (Colonial temperature-sensitive 3) [*Gibberella zeae*] | NF01706540 |
| 766 | conserved hypothetical protein [*Gibberella zeae*] | NF01717050 |
| 773 | hypothetical protein FG03993.1 [*Gibberella zeae*] | NF01706971 |
| 774 | hypothetical protein FG03994.1 [*Gibberella zeae*] | NF01706918 |
| 777 | Hypothetical protein (Related to phosphatidyl-ethanolamine N-methyltransferase) [*Neurospora crassa*] | NF01489841 |
| 780 | hypothetical protein MG10688.4 [*Magnaporthe grisea*] | NF01578406 |
| 781 | Hypothetical protein ((AJ296278) putative 60s ribosomal protein) [*Neurospora crassa*] | NF01490749 |
| 785 | hypothetical protein FG05901.1 [*Gibberella zeae*] | NF01711268 |
| 788 | ABC transporter PMR5 [*Penicillium digitatum*] | NF00246136 |
| 790 | hypothetical protein FG06111.1 [*Gibberella zeae*] | NF01712281 |
| 791 | hypothetical protein MG06293.4 [*Magnaporthe grisea*] | NF01582543 |
| 793 | predicted protein [*Emericella nidulans*] | NF01785418 |
| 794 | hypothetical protein FG07016.1 [*Gibberella zeae*] | NF01708057 |
| 796 | Hypothetical protein [*Neurospora crassa*] | NF01487960 |
| 800 | Hypothetical protein [*Neurospora crassa*] | NF01490566 |
| 802 | Probable inosine triphosphate pyrophosphatase [*Neurospora crassa*] | NF01287098 |
| 805 | hypothetical protein MG01504.4 [*Magnaporthe grisea*] | NF01573616 |
| 809 | hypothetical protein FG08572.1 [*Gibberella zeae*] | NF01714474 |
| 810 | ADP, ATP carrier protein (ADP/ATP translocase) (Adenine nucleotide translocator) (ANT) [*Neurospora crassa*] | NF00649281 |
| 811 | hypothetical protein FG08391.1 [*Gibberella zeae*] | NF01712334 |
| 819 | Hypothetical protein [*Neurospora crassa*] | NF01485743 |
| 820 | hypothetical protein MG04719.4 [*Magnaporthe grisea*] | NF01573760 |
| 821 | hypothetical protein FG05434.1 [*Gibberella zeae*] | NF01716288 |
| 823 | Probable glutamate synthase (NADPH) [*Neurospora crassa*] | NF00648682 |
| 833 | Multidrug resistance protein MDR (ABC-transporter) [*Emericella nidulans*] | NF00176333 |
| 835 | hypothetical protein FG07453.1 [*Gibberella zeae*] | NF01710295 |
| 837 | hypothetical protein FG08338.1 [*Gibberella zeae*] | NF01714420 |
| 841 | hypothetical protein MG03351.4 [*Magnaporthe grisea*] | NF01573271 |
| 844 | hypothetical protein FG02564.1 [*Gibberella zeae*] | NF01713345 |
| 851 | hypothetical protein FG07977.1 [*Gibberella zeae*] | NF01706394 |
| 853 | hypothetical protein FG09253.1 [*Gibberella zeae*] | NF01716450 |
| 856 | Elongation factor 1-alpha (EF-1-alpha) [*Hypocrea jecorina*] | NF00494402 |
| 857 | hypothetical protein MG00814.4 [*Magnaporthe grisea*] | NF01577550 |
| 860 | hypothetical protein FG07778.1 [*Gibberella zeae*] | NF01715768 |
| 862 | conserved hypothetical protein [*Gibberella zeae*] | NF01713966 |
| 867 | Probable 40S ribosomal protein S5 [*Neurospora crassa*] | NF01527794 |
| 870 | Isocitrate lyase (EC 4.1.3.1) (Isocitrase) (Isocitratase) (ICL) [*Neurospora crassa*] | NF00649093 |
| 876 | hypothetical protein FG08530.1 [*Gibberella zeae*] | NF01710746 |
| 878 | Hypothetical protein PFI1335w [*Plasmodium falciparum*] | NF01067476 |
| 880 | hypothetical protein FG07102.1 [*Gibberella zeae*] | NF01713887 |
| 887 | hypothetical protein FG09422.1 [*Gibberella zeae*] | NF01714429 |
| 893 | hypothetical protein MG04989.4 [*Magnaporthe grisea*] | NF01582762 |
| 894 | hypothetical protein FG03577.1 [*Gibberella zeae*] | NF01707340 |
| 896 | hypothetical protein FG01219.1 [*Gibberella zeae*] | NF01709359 |
| 901 | hypothetical protein FG03994.1 [*Gibberella zeae*] | NF01706918 |
| 903 | hypothetical protein AN1608.2 [*Emericella nidulans*] | NF01784340 |
| 909 | Hypothetical protein SCO0467 [*Streptomyces coelicolor*] | NF00550337 |
| 910 | Beta-xylosidase precursor (EC 3.2.1.37) [*Hypocrea jecorina*] | NF00494350 |
| 911 | hypothetical protein FG09878.1 [*Gibberella zeae*] | NF01713637 |
| 913 | Probable 40S ribosomal protein S5 [*Neurospora crassa*] | NF01527794 |
| 916 | NADH-ubiquinone oxidoreductase chain 4 [*Hypocrea jecorina*] | NF00873689 |
| 920 | Predicted protein [*Neurospora crassa*] | NF01484649 |
| 921 | hypothetical protein FG06754.1 [*Gibberella zeae*] | NF01710230 |
| 925 | hypothetical protein FG03072.1 [*Gibberella zeae*] | NF01709591 |
| 927 | Clock-controlled protein 6 [*Neurospora crassa*] | NF00647506 |
| 933 | Hypothetical protein [*Neurospora crassa*] | NF01485547 |
| 937 | hypothetical protein FG10782.1 [*Gibberella zeae*] | NF01707462 |
| 940 | Probable maturase [*Hypocrea jecorina*] | NF00873684 |

TABLE 4-continued

Function Description of ESTs and SSH clones

| SEQ ID NO. | Description | PIR Accession Number |
|---|---|---|
| 941 | Hypothetical protein [*Neurospora crassa*] | NF01488438 |
| 944 | hypothetical protein MG10181.4 [*Magnaporthe grisea*] | NF01577807 |
| 946 | Hypothetical protein H4H7.110 [*Neurospora crassa*] | NF01485963 |
| 949 | hypothetical protein FG06588.1 [*Gibberella zeae*] | NF01710623 |
| 952 | Hypothetical protein (Probable glucokinase) [*Neurospora crassa*] | NF01484367 |
| 953 | hypothetical protein FG01154.1 [*Gibberella zeae*] | NF01707852 |
| 955 | conserved hypothetical protein [*Gibberella zeae*] | NF01714033 |
| 956 | Hypothetical protein [*Neurospora crassa*] | NF01489636 |
| 958 | QI74 protein [*Hypocrea lixii*] | NF00756616 |
| 961 | hypothetical protein AN3199.2 [*Emericella nidulans*] | NF01781622 |
| 970 | Endo-1,4-beta-xylanase (EC 3.2.1.8) IIB (Proteinase-sensitive) [*Trichoderma viride*] | NF00756643 |
| 972 | hypothetical protein FG07946.1 [*Gibberella zeae*] | NF01716616 |
| 975 | 60S ribosomal protein L16 [*Neurospora crassa*] | NF00648465 |
| 977 | Frequency clock protein [*Hypocrea spinulosa*] | NF00426736 |
| 978 | hypothetical protein FG00578.1 [*Gibberella zeae*] | NF01715708 |
| 981 | Hypothetical protein [*Neurospora crassa*] | NF01486656 |
| 982 | hypothetical protein FG05145.1 [*Gibberella zeae*] | NF01707421 |
| 984 | hypothetical protein FG06394.1 [*Gibberella zeae*] | NF01716035 |
| 988 | hypothetical protein FG06328.1 [*Gibberella zeae*] | NF01706390 |
| 989 | hypothetical protein FG04412.1 [*Gibberella zeae*] | NF01717062 |
| 991 | hypothetical protein FG09233.1 [*Gibberella zeae*] | NF01709847 |
| 993 | hypothetical protein AN2875.2 [*Emericella nidulans*] | NF01787595 |
| 994 | hypothetical protein FG03563.1 [*Gibberella zeae*] | NF01705877 |
| 995 | hypothetical protein FG07011.1 [*Gibberella zeae*] | NF01715546 |
| 996 | Apocytochrome B [*Hypocrea jecorina*] | NF00873696 |
| 1002 | hypothetical protein FG04512.1 [*Gibberella zeae*] | NF01714942 |
| 1004 | hypothetical protein FG05467.1 [*Gibberella zeae*] | NF01714488 |
| 1015 | NADH dehydrogenase subunit 3 (NADH-ubiquinone oxidoreductase chain 3) [*Hypocrea jecorina*] | NF00494385 |
| 1020 | Hypothetical protein [*Neurospora crassa*] | NF01483424 |
| 1022 | Hypothetical protein [*Neurospora crassa*] | NF01485488 |
| 1023 | hypothetical protein FG10920.1 [*Gibberella zeae*] | NF01711642 |
| 1027 | hypothetical protein FG07245.1 [*Gibberella zeae*] | NF01708545 |
| 1028 | hypothetical protein FG01586.1 [*Gibberella zeae*] | NF01709463 |
| 1029 | Hypothetical protein [*Neurospora crassa*] | NF01485668 |
| 1030 | conserved hypothetical protein [*Gibberella zeae*] | NF01715089 |
| 1033 | hypothetical protein FG00854.1 [*Gibberella zeae*] | NF01714634 |
| 1034 | hypothetical protein FG08125.1 [*Gibberella zeae*] | NF01706145 |
| 1036 | hypothetical protein FG10345.1 [*Gibberella zeae*] | NF01714154 |
| 1037 | hypothetical protein FG01861.1 [*Gibberella zeae*] | NF01716331 |
| 1038 | hypothetical protein FG01843.1 [*Gibberella zeae*] | NF01711037 |
| 1039 | hypothetical protein FG06003.1 [*Gibberella zeae*] | NF01708535 |
| 1041 | Plasma membrane H+-ATPase [*Aspergillus fumigatus*] | NF00795376 |
| 1043 | hypothetical protein AN6831.2 [*Emericella nidulans*] | NF01781110 |
| 1044 | hypothetical protein MG05487.4 [*Magnaporthe grisea*] | NF01578435 |
| 1049 | hypothetical protein FG05066.1 [*Gibberella zeae*] | NF01714926 |
| 1052 | hypothetical protein MG05197.4 [*Magnaporthe grisea*] | NFO 1582047 |
| 1054 | hypothetical protein FG06356.1 [*Gibberella zeae*] | NF01715584 |
| 1056 | hypothetical protein FG01606.1 [*Gibberella zeae*] | NF01714118 |
| 1060 | Probable HDEL receptor ERD2 [*Neurospora crassa*] | NF00903991 |
| 1063 | hypothetical protein MG04438.4 [*Magnaporthe grisea*] | NF01577745 |
| 1065 | RAN_BRUMA GTP-binding nuclear protein RAN/TC4 [*Gibberella zeae*] | NF01708935 |
| 1067 | hypothetical protein FG10303.1 [*Gibberella zeae*] | NF01707774 |
| 1068 | hypothetical protein FG01656.1 [*Gibberella zeae*] | NF01708271 |
| 1069 | hypothetical protein FG07120.1 [*Gibberella zeae*] | NF01713195 |
| 1075 | hypothetical protein FG04392.1 [*Gibberella zeae*] | NF01710243 |
| 1077 | Cytochrome P450 oxidoreductase [*Gibberella fujikuroi*] | NF01399523 |
| 1079 | hypothetical protein FG01297.1 [*Gibberella zeae*] | NF01715472 |
| 1080 | hypothetical protein FG08463.1 [*Gibberella zeae*] | NF01710966 |
| 1081 | hypothetical protein FG00644.1 [*Gibberella zeae*] | NF01706083 |
| 1082 | hypothetical protein FG08610.1 [*Gibberella zeae*] | NF01706364 |
| 1084 | hypothetical protein FG09229.1 [*Gibberella zeae*] | NF01711344 |
| 1086 | hypothetical protein MG03911.4 [*Magnaporthe grisea*] | NF01579335 |
| 1089 | Cytochrome c oxidase polypeptide II [*Hypocrea jecorina*] | NF00873681 |
| 1090 | Endoglucanase IV precursor (EC 3.2.1.4) (Endo-1,4-beta-glucanase IV) (Cellulase IV) (EGIV) [*Hypocrea jecorina*] | NF00494352 |
| 1098 | Similar to tr|Q96WT5 *Aspergillus oryzae* Maltose permease [*Debaryomyces hansenii*] | NF01905886 |
| 1101 | hypothetical protein FG04027.1 [*Gibberella zeae*] | NF01714863 |
| 1104 | hypothetical protein FG05231.1 [*Gibberella zeae*] | NF01713188 |
| 1106 | Beta-xylosidase precursor (EC 3.2.1.37) [*Hypocrea jecorina*] | NF00494350 |
| 1107 | hypothetical protein FG08312.1 [*Gibberella zeae*] | NF01714073 |

TABLE 4-continued

Function Description of ESTs and SSH clones

| SEQ ID NO. | Description | PIR Accession Number |
|---|---|---|
| 1111 | hypothetical protein FG02406.1 [*Gibberella zeae*] | NF01711411 |
| 1119 | Beta-tubulin 2 [*Hypocrea virens*] | NF01248224 |
| 1120 | ATP synthase protein 9, mitochondrial precursor (EC 3.6.3.14) (Lipid-binding protein) [*Neurospora crassa*] | NF00648607 |
| 1124 | hypothetical protein FG04387.1 [*Gibberella zeae*] | NF01716461 |
| 1125 | Probable adenylate kinase (EC 2.7.4.3) (ATP-AMP transphosphorylase) [*Neurospora crassa*] | NF00648385 |
| 1126 | hypothetical protein FG10717.1 [*Gibberella zeae*] | NF01705725 |
| 1127 | Hypothetical protein [*Neurospora crassa*] | NF01490566 |
| 1128 | PMA1_NEUCR Plasma membrane ATPase (Proton pump) [*Gibberella zeae*] | NF01716280 |
| 1129 | hypothetical protein FG05853.1 [*Gibberella zeae*] | NF01707732 |
| 1131 | hypothetical protein FG07218.1 [*Gibberella zeae*] | NF01709286 |
| 1133 | hypothetical protein FG09492.1 [*Gibberella zeae*] | NF01715612 |
| 1136 | hypothetical protein FG06073.1 [*Gibberella zeae*] | NF01712503 |
| 1138 | hypothetical protein FG01544.1 [*Gibberella zeae*] | NF01715994 |
| 1141 | Hypothetical protein B2G14.120 [*Neurospora crassa*] | NF01287101 |
| 1142 | hypothetical protein FG09052.1 [*Gibberella zeae*] | NF01707043 |
| 1143 | Class V chitin synthase [*Glomerella graminicola*] | NF01209406 |
| 1144 | hypothetical protein FG01262.1 [*Gibberella zeae*] | NF01706669 |
| 1146 | Alpha-glucuronidase precursor (EC 3.2.1.139) (Alpha-glucosiduronase) (GLRI) [*Hypocrea jecorina*] | NF00494377 |
| 1147 | Hypothetical protein [*Neurospora crassa*] | NF01487149 |
| 1148 | Hypothetical protein (Related to brefeldin A resistance protein) [*Neurospora crassa*] | NF01485464 |
| 1153 | conserved hypothetical protein [*Gibberella zeae*] | NF01712603 |
| 1155 | Probable maturase [*Hypocrea jecorina*] | NF00873685 |
| 1158 | Endo-1,4-beta-xylanase 1 precursor (EC 3.2.1.8) (Xylanase 1) (1,4-beta-D-xylan xylanohydrolase 1) [*Hypocrea jecorina*] | NF00494326 |
| 1160 | hypothetical protein FG06931.1 [*Gibberella zeae*] | NF01710995 |
| 1165 | hypothetical protein FG06756.1 [*Gibberella zeae*] | NF01707441 |
| 1168 | Putative endo-exoxylanase [*Leptosphaeria maculans*] | NF01286326 |
| 1168 | Putative endo-exoxylanase [*Leptosphaeria maculans*] | NF01286326 |
| 1170 | Acetyl Xylan Esterase [*Hypocrea jecorina*] | NF00494390 |
| 1171 | hypothetical protein FG04827.1 [*Gibberella zeae*] | NF01705701 |
| 1172 | hypothetical protein MG00373.4 [*Magnaporthe grisea*] | NF01579634 |
| 1173 | Hypothetical protein [*Neurospora crassa*] | NF01486658 |
| 1174 | Acetyl Xylan Esterase [*Hypocrea jecorina*] | NF00494390 |
| 1176 | alpha-glucoside permease [*Saccharomyces cerevisiae*] | NF00363631 |
| 1177 | hypothetical protein FG10292.1 [*Gibberella zeae*] | NF01717020 |
| 1181 | hypothetical protein MG01710.4 [*Magnaporthe grisea*] | NF01582967 |
| 1188 | Hypothetical protein (Related to berberine bridge enzyme) [*Neurospora crassa*] | NF00649183 |

The invention described and claimed herein is not to be limited in scope by the specific embodiments herein disclosed, since these embodiments are intended as illustrations of several aspects of the invention. Any equivalent embodiments are intended to be within the scope of this invention. Indeed, various modifications of the invention in addition to those shown and described herein will become apparent to those skilled in the art from the foregoing description. Such modifications are also intended to fall within the scope of the appended claims. In the case of conflict, the present disclosure including definitions will control.

Various references are cited herein, the disclosures of which are incorporated by reference in their entireties.

SEQUENCE LISTING (1190 sequences)

SEQ ID NO: 1 - DNA, 517 bp, Tricoderma reesei
gaattcggcacgagggctggacgccgaccgcctcggctctagcggcatcaagccctttcgctatggcagatatggacaggtagacctgggtcagctgcggatggagattgtgagctgcgacggcggcatgttctccaaccagtcttcgtatgcggcggagaacatcctcaaggacgacaactccgtctactgcactaaggggaacagatgcaacattgtgctgcaacaccaaggcgggagtgtctttacgctgcaggagcttgtcatcaaagcaccgtgcgctaccaacttttcccatcccgttcgagagggcatgatcttcatcaccatgcaccaggacgacatgctgagccggacggctcaatatcagatccagtatgccccgtcatcgaggcagcgttcacggaatgcagacggagacaatgcactggtcctcgaacgggaacctcggcacatcgtatccattcagcatcacgtagacggcaccacgagcaccaggactagaagatcctatgtg

SEQ ID NO: 2 - DNA, 196 bp, Tricoderma reesei
attcggcacgaggaacctcgacgttagaggtccttctccagcgctgtttcaaatgtcggcagaatctcttttccccagtcttctttgtcccttgtcttttcaggtctaccgagatcatacctagactaccttagtaccgtatcactcactacctaggtgctatcaaggtgcacgccgtttccacaacacagcacag

SEQ ID NO: 3 - DNA, 153 bp, Tricoderma reesei
gatctctggtgccgacctctcaatcgcacgcgtcagagcatccccctggttggcagggtacaggtagggcgactcagtagccagggcgtcgatgcgctcaacaatctcatgaggcagactcgacggcgagaagggcttcttgtggcatcccac

SEQ ID NO: 4 - DNA, 588 bp, Tricoderma reesei
gcttttactggtttgtcatgatgatacgggcggtcctcaagcggttcaagcccaacgagaagcttgccatcaccgaggccgaagtcgacctgtcgtcgattgcctctggtgtgtctctgggttctggggcgcagcgtcgcaagcaggacaagtcttgagagtttaggacgttggaatcctcctgaatcttggcgtggctcccatgattttgtcatttgcgacgtttcgagggctctctgtgtcatggggctgggtggtgcggcggtcaggcgacctacctactagaagggcacgggcatgatgcgcgcgatgctgtgcaggtgctgtgcggtgggatatatgtgtggtcattttgattttgtgcaatcatgttaatggaaatgtttcatgacagttcttttttcctttttatcctgttttcccccttttcctttttttttcttttcttggtttggcttggggagcagcaggatcagcagcatgcatgacacatacatacattatacattagactattgaataaatgaatacaccaaagaaaaaaaaaaaaaaaaaaaaaaaaaaaaaaaaaaaaaaaaaaaaaaaaaa

SEQ ID NO: 5 - DNA, 143 bp, Tricoderma reesei
gagtttccctacggagacttggccgtctttgaagcgcaagacagccaagacggcctgctcgatcactttcgccgcctgctaacagaaggctcctggtccgatattgcccatctgaggagggtcatgaggtccatgatgggcga

SEQ ID NO: 6 - DNA, 566 bp, Tricoderma reesei
gaggattcccttcgagattcagccaaagctcatctttgacagactggtggacattctttttggtatacagaaatgcttgtcgattgccagccgtctaatcacctccaagtctgatcaaagagacctgctgaagcatgaactcgctctttccatccagaatgcaagactccaaattcgtcaatggcgatcagaggccctttcatacgcccctcgcaaagatggccaacagtatcaagaggcctcggagcctgtagctgacgcccagattgctgcatctgctgatggcctccatttcatgctgccgtacagcgatatcgcatcagcggcactagtcacgctctatgatgcggccaatgtcattgtgctccggctcttgtgtctggtgtctccgggggcagcctcgcataatgagcgtatccagcaccactcggagtccatcttgtcagcgcatgccatgatcaagccatcatcatgctctgtacctggtcgcagctccatcatgttggttcagcagctgaaggccgttgcactgtggagcacctccgcgcggcagagagcattggcta

SEQ ID NO: 7 - DNA, 755 bp, Tricoderma reesei
aaaaaatatgagagaaagatttgcgagcattgtgaaatcgactgcgtccccaatggaaacggacctccgtgatcgcacaatacattggcgcgtagtctctcagtttgcatcacccggctccagatacaacgtatctccatgttgcagtagcaccttcagtacgtcttcgcaatattcgatggagttgctggtggtggtgatactccgtgcttcgtggtagagagtaacagtcgatggctcgctgctaaaccacttcgtctggcgtctcaacgcgttcctgtttccatgaaccaggagcgcgcattgtatccaaccacctgacaaacgcgtactaggtagtcgtagtacccaggaaccttgtatcagcgcgcaagtgtgcttgcgagagacaaagaaccctggatgcactgcgtcgaacgagctgctcctcgtcgaccattctgctagtacaagccaccacttgtcaggatgacattcgacacctttagcggtcaatcgccttctgcgtcacgctagaagccctcctttgacaggaagtggcttcgaatggccttgactctatgcggagggattgcgtagacgggatgggtggtcgcaatgcggtcctcttcatcgaaaatctggacaccgcccgtgtgaggtgacgcctcccagcgatcgtcccccaggagggtctcatcggcacgagaggcaacaaaacgccacttggtcctgcgcggaactgaggccggacagaacgtagcaggagtggtacg

SEQ ID NO: 8 - DNA, 513 bp, Tricoderma reesei
tcaggaaccggcagactttggaaactaccttcatttgccatcgcatgccaaggacgcccaacttggctttcaagtcttgcatgcgtagaacaccccactctttacagacggccattatagtggttgcaagggctgtataatcaacagcttcaccagtccatcttgtgtgccaaggaacagcgtcaaggatgacagccagaacttggcgagaaagattcatctctgcctccggttctgtagctgcgctgctatctttcggcagcggaggggcgaaaagcttgagccacattttgctggttttggttccccggacaagtgtggtacgcttagtaatgtagcctttctttacaagtgcatccgttcgcttcggtactgaacgcttgtcttggtcgaccagacggccaagatcaccttgcaggattccgtttgctttcgtcgaagcgatgccaagaagcagaagccattcggaacgaggaacgcgcttgtaatccaccgcatgcccggtaatagcct

SEQ ID NO: 9 - DNA, 683 bp, Tricoderma reesei
taactgctctcgagatacctgctattccatcaaacatctctcaaacatcttctttttctgcaatctcgatcgtcatggcagccgaatcaagcgacgtggtgcaggtctccattccgctgccgcggtcgttggatacccgcgttttcatccgcgtggcaacccaggccaaggcgattctcctctctctcaccacggcgtctcacgaggagtcgtcttcgctgaggcccatgggctcttttgtctatgcactccccgacgtaagccttaggtcactgtcgagagtggcagcttgagaacgttgaggttttgtcaactgacttcttgaaccagagattcgaccagcagcaagcaatcgccactacgctcttctccgcagagtcatctctagagtttacgacccgcgttgcaaagctcgtcgcccgcaagacgcagctgcccgtgtatgtgacaaactccatcagtctcgagagcatgggcatgggcggcaccgttgaggaggagatggaggcgttcaagggcgtggccgaggcgatcctgagcacccttcccaagaacgtggtgcccagctgagcagcgtgagagagtgcggtagtctatgaagcgaacccaggcctctgcaccgccacggcctatattctggcatgcacatgttgggaaagcaggcaaggcaggtccatgacggg

SEQ ID NO: 10 - DNA, 175 bp, Tricoderma reesei
gagtctctctcagttccatgctgttctgctttcatacgtttctttcgtgtctgggatgctccttatgttgttgctctgctttattctcacatggacatatactcacatacatcactacaactactattatactaaaaaaaaaaaaaaaaaaaaaaaaaattcctaagctgcggcc

SEQ ID NO: 11 - DNA, 410 bp, Trichoderma reesei
tccgaattcggcacgaggcacggcgttggctctgcgtttttgttgttccagctgatgggcttttttacaactttggtgtgctctgttcaaaagagggctgggggaaagtggatttggaagaaaaggaaagtagagaatttgggtgacttcgtacccagtttctttttctgttgtgggaactggatggtatcggggcatggaaatgcgagacgaggctcgggaagacatgtcatgtcatcgaatcatagcacgtcgcatttatatcacaacgcatcattctgcggtgtacgtggttttcggtcctccatgcatgtgctagttgtacttaggagagcgatggaataaccacattctgtcttgtttcaaaaaaaaaaaaaaaaaaaaaaaaaaaaaaaaaaaaattcctaagc

SEQ ID NO: 12 - DNA, 715 bp, Tricoderma reesei
tccttcgctttgaaacggcaacgtcgccttcatcgaacaaagtaccattccccatccacactgtcgtatcttgggccactcgacaaccatacccaacatgaaactgtccgggccaccgctcgtcttggtcgcgactggcgtcatcggctccgcatggctgtctggggccatcatatcattctcgatcggcggagctccagctgctgctgcagtgaaccaatcgtctgctaagatatgggctgaactgtacaagcgtggagctgcttcgatgcccaagttcgccgtcggcacttctttggcttacattcttgcggcatacagtgcgtatggcaacggcgggccatgggggagctacctgggagcctctgcttgcgtgctgtccatcgtaccttttaccctgacagccatgaaagatgtcaacgggtcattgcacgaagaggctgacagagaagccagtgaggagacgcaggtgtccacggtgcgcgtcaaggggctcctggatagatggatcaccttgaacctggttagagggctcttaccgcttgctggaacagccctgggctgctttgcattctaccatgagggattctgatggcacaaattgtcgctctgtcgatatcgatacgtgttccaccagcccagattgcctaaaaggctggccgcgtgtcgttcttgggttctcctgtgttctcgattcaactgtcaagatgcaaca

SEQ ID NO: 13 - DNA, 645 bp, Trichoderma reesei
ggctggccgacggggggcggcaaagactgcgggaggcccgtcgacgtgcccggatcctgccgtggcgggcatcgacgagctcaacacctttatgaacgactgggtgtgccaggcgctggagaacggcaccaactacttttggttcgaggcctttgacgagccgtggaaggtcatatacaacaccaagggcaaggagtgggaggacaaatggggcctgatggacgccaaccggaagctcaaggacggagtcaagattcccgactgcggcggcaagactgtttcttgaggccgcccgcggcaggtccttattgtatgtatatactccattttgtttcctttggtcttgtgatttacgggttgatgaggcatgatggaaagcgaaacgatgttctgtgctgttgtttcatacatatctactcgcggcaaccctcttccacccaccctgctgctgcagcagcagcagcagcagcatcccctttatttccccccgggagctacaggcctcgagtcttttgatccctgtttatggttcttcactgtctatcgctaatcgcgtgctgttttgtcacctattggttctcctttttttctttttttttcttttaccttactgccctatatttatgctagatgatggatctggcg

SEQ ID NO: 14 - DNA, 111 bp, Trichoderma reesei
gaattcggcacgaggggcggcgttctgcgagccatcgagcaggcgttcccaacacccgatgtcggctccatcgagcccgccgagctcctcctcagcgtcgtcttccccgcg

SEQ ID NO: 15 - DNA, 658 bp, Tricoderma reesei
gaattcggcacgaggatctctctcattctctctttcgctctctctctccctctctctctctctctctctcgcgaacgtgacgaccatacatttgacggaaggcctccttatgactctgaacgaacttttctttttgtctttgctgttctttctttgatagttacctcgtttatgctcacagacattttcagcttgtcatagatgactcctctgatttagatgggactgtcactggcatagcgagcaaacccaccggtctctgcataccttgagcttggaagaaccgtcgctcttagactgcagtcccccctctctttaaacttgtttccttgctgtcaactttccttgcccaccaaaaaagcagcctcttgttgtgcgaacaaggcccccccccatcacgcaaaagattgcaaagagctacacgcattttttcctatagtgctccaaggggaagagtaaattacaagttcaaaaacaaccaaaaaaaaaaaaaagaaggatcttctttcagcacagtctttgtatttcacctaggcacctgttatgatgagctcccggccttggaacatagttattcagaggggtgggagcgtgtctgtgggtagggcatatcgggatattgcaaattcaattggcgtatcagtacaacgaaaaaaaa

SEQ ID NO: 16 - DNA, 186 bp, Trichoderma reesei
gaattcggcacgaggcccgacgcacgacaccgatttccttcagcgtctctcgaagcccatcgggtccaaagcagtcagatgctgtcgggccttgctcaggcatcttgagagagaaaaaaaaaaagctcttttcccatccgaccggcgtctcgtcgagcctctcgtttagcagtcccggcctcgttc

SEQ ID NO: 17 - DNA, 199 bp, Trichoderma reesei
gaattcggcacgagggcacagcttcgcagccgccttggttcctgctcatgaagtcgctagtgaggagcctgcagcctcagaccaaaacattgtgccgcttcacccacccgcgataacgaacaagagtcgattactctgtacctttccacacttaccgaccgtgggtggtttatcaatactattccaaccaccgaatcgc

SEQ ID NO: 18 - DNA, 211 bp, Trichoderma reesei
gaattcggcacgagggattatacctactgtccatcagtttattgtcgtgtatcccatttctcagccgcagtgaaccacctcaccttcatttacatcccctctccaacttatacctactactcatcgggcaccactccgacacagcccggtgatacaaagactgtctacatacctacaataaaccccgtagaacataccacaatcatcgagc

SEQ ID NO: 19 - DNA, 243 bp, Trichoderma reesei
cggcacgaggctccggccggtcggtgtttgcgttgcagagaggaaagaccacctgacctggcctacgacactcttcctctttctcacttttgacgattctgcgcctcggtgtgaggagacacaagcgatccagaattcgcagctgccttgagaagcttgttcaggcagcaccagccaaaatcactctggacgaggaaaacataaatactacctatctaccttacttcttctcattcaattctc

SEQ ID NO: 20 - DNA, 749 bp, Trichoderma reesei
cacgaggcatattcattaaactgcttacctaaagcactcaattgagcaagtgtggcgccatctcggaaagcggggccttgattcagcgcagggattccaacgtcatacaagacgagtcacagagcgggcggacactcaaggaaagcgcaggtgcccagtgagacaaacagcagcaggagggccataaacaggacacaccggccaccaacagactttctgagaagctcttgcaatccatttcctccctcgcaaacctaacacacacacacacacacacacgcaccacctcctcacttcttccttttactcttcatctttctccccccttttcttccactctttcaatctacctactatcgcgcatcgctgtgcatcgcaaacaatcattgaaaggcgatccccacagcaaagcgaccggacctacattcacaacaagtgacgacgacacttgggttctctattgctgattccatcgacctgtcgaggtcggcgacgcaactcttacctttctctctctctctctctctctctctctctctctggcatcctccctttatttatccagcaggcatggcgccagtaatggacctcttcgctcgagatagcatctgcggatacggctactattacgatggattcggttgtcggcgcaggagcggctggtacttttggggcagatgggtgctcgccggcatcgccatcgttctggcattgattctcttggctagctgcctctgcattacacgacg

SEQ ID NO: 21 - DNA, 226 bp, cgaccatgag tagaagctga tccagtgaag aagacgggct gctgc0
cgaccatgagtagaagctgatccagtgaagaagacgggctgctgctctgcccaacgagcaagctcatcagagagagatggcgagagcttcatgatgccggggagcgacggcgtggtctcagcaaggtgtgctgtgactggccaccaccactcacaagtgacgttagaggcagagcaatcttgggcaactaggcggcgagagagggatgcaatggccgaaacataga

SEQ ID NO: 22 - DNA, 169 bp, Trichoderma reesei
ggcatcgattttgagccgcgccgtgctccttaagcagactggtggcggcacccctgagcagtgggagaaatgggatcaaacatatgaaaccttcttcagcaggctcgaggtgtcactaccctacatgttccctggcagtatcaacacgggctcggacgtctacgtgtgg

SEQ ID NO: 23 - DNA, 156 bp, Trichoderma reesei
tcggaatcgctcgcatcgtcgtcggcggcaggcccggagacgcgcgtcagacggccgtactggcaacccggcgcggactcccagaggctgccgtctgcgtctcggaaagtatagacttgggtgtctgcatcgtagccgacgcgggtcatgccctcg

SEQ ID NO: 24 - DNA, 150 bp, Trichoderma reesei
cgtttttggcttcatcaccattgccctctttggcttgtacgagaaccgagtcgccaagttccccgtcatgcccactcgccttttccgtggcaggaccagcattgccgcctatggcctgtctatcatgcacgccatgaccttcatgtccgg

SEQ ID NO: 25 - DNA, 322 bp, Trichoderma reesei
tcgagcggccgcccgggcaggtacaatcaagggtgggaaaattggatcaaaacggaatctcgagcctgggctagctccaagacaagaaggacgcacatgatggcaacttcaatagatcatggtccaaaatagaacagggaatttcgaatcagggtttctctacgctgttgcatgatagacgttttggattcacgtggtttctaccatcatgggctatttttcttttgtctccggcttgtgggttggtttcttttgtatttgggcagacaggctttgctgctgtgtgtgtgagcgagcgagtgtacctcggccgcgaccacgc

SEQ ID NO: 26 - DNA, 210 bp, Trichoderma reesei
gcgtggtcgcggccgaggtcggccgaggtaccctcttggtgcaaatcttcatgatgatttcttgcaactatggctttggcaaacacattgcatcgttgtcagtcagtgacaagctagcagccctcaagtggttctacgtggcacaaatcttctacaagctgaccatcaacctgacgaaaatgtcaattgtacctgcccgggcggccgctc

SEQ ID NO: 27 - DNA, 743 bp, Trichoderma reesei
attcgccctttcgagcggccgcccgggcaggtacagatgcgatgacgggacggttaacgactttctgtaagatgaagtcgaaataatgattcgtcgaccgatcgtatgttctaccgagaatcctaaaggagtgtggtaaaacagttggagcgctctcgaaatcacgaagaacctagcgaatggccgttagcgtttgatggctgcagagatcagctgcccgatgccatggatgaatgagatgccaagggtgatagaaacagccccaaatgccccatgaactctagatgcccagagcagatgcctggatcaaagtagcgaaacacatatctcgcaacgtctatgttccttgcgcatttcctctctgaatacacgtttctgagatagtcgcaatatgattgggagcctccatgcccaacgtctcccgtcgtgctggatcccctgtctcgatgtgtcatgtgtccgccgtggttggttggatgctcgtagatcgtagatgatcgtcctctccaggatatatatagctccgatggcaccgccaggagcactccgtcttgaagaacttgcaaacgcaagcaagaatggttccaatgatgcggtagagatgcttcgccaaaagtgtataatagcccatgaggaggtgagttggatggtggcaaacgggcaacgcgccaatcgcatgcaactcctccagggcaaggggcaaaagagcccgtttgtcgttggtacctcggccgcgaccacgc

SEQ ID NO: 28 - DNA, 571 bp, Trichoderma reesei
cttagcgtggtggcgggccgaggtaccctacacggattcgggccgggccatggcccaagatgaagtgggcaattcaggatggcactctctcaacttcgtattcaaatttgctggaatttctctttgccttggttatataccaagccgaaccgggacctttggggttgatgaggtaatatgacttgggcacgtcgtctggctgatgatggctctgggtggctttctgtggcttctctgcaatggccacttcagaaaccaacaacgggggaagcaatttggctcgtcgctctgcgacgtgatgtcttggacgctggttggaaagacagggggtggctcgtctcttgcatagacattgatcgcttctcactggggtcgttgatggccgatttggagattcgagcaagactggggtagctggcggccttggagccagcgcttggatcagacctgagcttctccatggcgatggaagtgataccaggctgcagcccgtcaaggtatggccgtaggggaatcgaggaggagtgcgtcgtggctcccgcggtgctgacctgcccgggcggccgctcga

SEQ ID NO: 29 - DNA, 371 bp, Trichoderma reesei
tcgagcggccgcccgggcaggtgaagattaggctcggcatggttgtcatccgcggcaactctgtggtcatgctcgaagctctcgagaggatcggcggcgacgacaggcaaaaccgatgaaacatgtccctttgaaccacagagaacgaccagcaaagctctgcggaatggaagatcaaatatgggaaaatatatacctgaaatcaatgtttttcgtttggcgtttacggagaccgacgacgaaagggaggagggcgatcacacgggattatctgatgcgcaggaaaaaaacgtcttgtccattgttgctagactgtttttggcactttgttcttttactccgaggctcaagtacctcggccgcgaccacgc

SEQ ID NO: 30 - DNA, 450 bp, Trichoderma reesei
gcgtggtcgcggccgaggtagcgcccaagaggtccaacgttgattactttgacgaaaccctctctcctcaacagcgagtgcacaagagctggaagctgtggagtttctacgtggacctggtggaaagcgtgtcaacactggatgaggtgaaaaaggtgtatgagcgcatctttgagctcagaatcgcgactccccaaacagttgtgaattacgccaacctcctggaagagcacaaatactacgaagaatccttcaaggtctttgagcgcggcctggacctcttcagctaccccgtagctttcgagctgtggaacctctaccttaccaaggctgtcgaccggaagattggcatcgaacgattgcgggacctcttcgagcaggcagtggaggactgtccgcccaagttcgccaagacgatctatctcatgtacctgcccgggcggccgctca

SEQ ID NO: 31 - DNA, 287 bp, Trichoderma reesei
gcgtggtcgcggccgaggtacttgtatcggaactcggccgcttctccctgagcacgctgggcaaatgctctagcatcggcaatggagcctgtgatgacgcatcccacggagggcgagatctggaagatgtgggagacagatgaggggtcgataagcttatcggggaccttcttctgtgacaggacaacagcgcagtccttgcctcgcaagcctacagacatgatgtttgcggctgtgattgccttgaaggcatattcgacttggtacctgcccgggcggccgctcga

SEQ ID NO: 32 - DNA, 330 bp, Trichoderma reesei
gcgtggtcgcggccggaagtttctggagggaaagacaaagaccggtgtataccccccgggcgggcgagatgtagatggtgagttcatctttccacacggagaattgctggacgtattttgggaggcaccccatcaaccaggttccgtatcgatgaagattgtccgccttgctctggtatttggctgttggattgatgaccggcgccttgagagccccaatggcctctctgggggctgttcgcatgttctgagaatcccgagggactgcgaccatccgaggagccgagaccgacattgctcgggtgatcacctgcccgggcggccgctcga

SEQ ID NO: 33 - DNA, 559 bp, Trichoderma reesei
gcgtggtcgcggccgaggtacaggtgcaggcggcgcaacatgctcagcactgccggactccattaccctgagatccaacgcaaagctcaacgatctgtttacaatgttcaatggagataaggtcaccacgaaagacaaattctcgtgccgccaggcagagatgtcggagctaatacaacgatatgagctcggcaccctgcccggacgaccaagcactctcacagcctcattctcgggcaatacgttgaccatcaattgcggagaggccggaaagtcaatttcattcacagtcacgatcacttatccatcttccggaacagcaccataccctgcgattatcggctatggaggcggcagtcttccagctcccgccggggttgccatgatcaactttaacaatgacaacatagcagcccaagttaatacaggcagccgcggacagggcaagttctacgatctctacgggagctcgcactccgcgggcgccatgaccgcatgggcctggggagtaagccgagtcattgatgctcttgagcttgtacctcggccgcgaccacgc

SEQ ID NO: 34 - DNA, 324 bp, Trichoderma reesei
gagcggccgcccgggcaggtccgcagttatctgctgttgatccgttgccagctcctgaaaacgacataaaaaaagaagaaaagaagaaaaaaacaagaagagacaaaagcatatcgactgcccatttcttttgaaagcactcccgacttcgatcttggaccgccgacaaagctcgaattcgaagccgcttgaccccatttccaaataatcacgaggaggattcgctggtccaatcagtcgtttctgattcccagtctgggaggagtatggctgctttgattcagacgtatcagcagcagactggtacctcggccgcgaccacgc

SEQ ID NO: 35 - DNA, 322 bp, Trichoderma reesei
gcgtggtcgcggccgaggtcgattgtgcccatgttttggctcgggaagaggttctgggtgaggatcagtgcgcaggtgtatttggatttgggagattatgagtatggcgcggagacgttgaagaagttgattgagagggttggcaagggggagtataagggtggccagaagatttgagagaagaaatccatagaaagaggtatatagggagtgttaatagggttgagtttcgttgctcgtgttaaaaaccaaaaaaacaaaaaaaaaaaagcttgtacctgcccaggcgccgcttcgagccctatagtgagtcgtattagaa

SEQ ID NO: 36 - DNA, 352 bp, Trichoderma reesei
cgagcggccgcccgggcaggtgtcgagatgcagagcaagaaggacgaccccgaccgacccaagaagatgacggtcggcaacactttccgctacatttactcgaacaatggtatcaagggtctttaccggggtgttactcctcgaattggtctcggcgtttggcagacgatttgcatggttgctgttggcgatatggctaaaacttacgtggagaaattgaccggcgacaaggtcacggctaagcattagacggcgtttgggtcagggctcatgatttggcatgacggttcaaaaattgggttctaatttacgcgcgaacgatgaaatgacggcggtgggaataattgccaac

SEQ ID NO: 37 - DNA, 168 bp, Trichoderma reesei
gcgtggtcgcggccgaggtacacgggcttggcgaacgatttggcgccttcaacaaggtcggacagagcgtgattctccggaacaacgacggcggtactgcttgaagacggggccgagcatggtctggacaacaacgctgggggcaggacctgcccgggcggccgctcg

SEQ ID NO: 38 - DNA, 225 bp, Trichoderma reesei
gcgtggtcgcggccgaggtgcaaacctcgtccttgccgcgtgcgagaactacagcttcacgacatgcgatgatggcattgtccactggtactgcttgaagacggggccgagcatggtctggacaacaacgctgggggcagggttggagatgaaggaggactcctcgtgcagctgcttggtgaagaggtcaacaccaaggtagcggtacctgcccgggcggccgcc

SEQ ID NO: 39 - DNA, 276 bp, Trichoderma reesei
gcgtggtcgcggccgaggtaccgtccgggagatgctgggaactgctcagagcattggctgccaggtcgacggaaagcctccccaggctattctcgaggccatcgagaacggcgagattgatatccctgaggagtagagtgtctggttcagaccacaagtcccactgagacgaaattctcggtctagggcgacaccaaaataaaaagaaacaaaaacgcccaacaaaaaaaaaaaaaaaaaaaaaaaaaaaagcttgtacctcggccgcgaccacgc

SEQ ID NO: 40 - DNA, 507 bp, Trichoderma reesei
gcggccgcccgggcaggttcgctcaagtccttccatgtcatgttgccgataacactgcgtgatgttcctcgattctgtcgagaacagaagtgtccgaggctcgcttacctaaacaggacccgggaaattgatcgatctcatatagcgggacaacacggcagcgttgatgtgtgaaagtgagatgaaataatgccagtcagaacatggcccatccacacagacacatatcacgctccgattcttctcgccgcccaaggctatgatgggtttcctacccgtatacccgttcctcttgttcaatagatgtattgcaatggtttaaagcaaacagatcagcccgaaaacatgtcttactctacatacgttgctgactcctcttcttcagtcagcggttatcccgtcacggttcagctcagcttcgagacgagggccggatacgaaagctattaagagcaagggcttttcgaattcgttgatgtagctcgtgtacctgcggctgcgaccacg

SEQ ID NO: 41 - DNA, 279 bp, Trichoderma reesei
gcgtggtcgcggccgaggtacgatgagatgcgagtgtgagcggacggggatggtggtgagtgagggtcgaggtttgtagatgccgcaaggctgcgttctggtgacgagttggagatgagagaagctgatgtgtttagaggaattgggcgggtgaaattggtcctgaagagcgctcagttggtgcttaacagcacgtcagagcctcgcattcactcagccagcgtcagaaagcgatgcagttgtcccgttgacagcgcttctacctgcccgggcggccgc

SEQ ID NO: 42 - DNA, 708 bp, Trichoderma reesei
gagcggccgcccgggcaggtttcaagccgaacagcaccaacatcatcgtgcagggcatgcagtgcaacggctctcacgggatctcagtcggctctctgggccagtatccggcagagtatgatatcgtcgaacacgtatatgtctacaatatctcgatgtccaacgccagcgacggagctcgtatcaaagtgtggcctggcactgatactccttttgaacccggtctctctggaggtggaggggccggatacgtcaagaacgtcacttacgacacctttcacaacaataacaatgactgggctattgagatcaatcaatgctatggccagagtaaccagacgatctgcgacaagtatccttccaatatgaccatcagcgatgtcgtattcaaaaacatgtggggaacaacttcgaagaagtatgaccctaaagttgggaccctgacatgctcgtctacggagaaaagcgtgaatatcgcggcgaagacatctcggtggttaatccgagtggcaggattcctccgtggatttgcaccaatatggacgaaagcctgctagacatagattgtgtcccggctacgtcagtaacaattttggcctcgggattatgttccgagcaggatggtggccaataaattgagagtattattgcccatattagggcgttcctttacctttcaaatgatcactccccctgcattggatgacc

SEQ ID NO: 43 - DNA, 311 bp, Trichoderma reesei
ggagcgggccgcccgggcaggtactctggcgtgccgcagaacgtgttcgtccggtcttcgtccttcatgtccagcttgcacaggccaaagtcgcacagcgcaatgtggccctggtagtcgagcaaaatgttctccggcttcagatctcggtagatgacgctaaaaccatgcaagcactccaaggcacagagaagctcggccgtgtaaaaccttgacctgttgacgtcaaagcggtgttctttctgcaagcggtggaagagctcgcctccattcacgaaagcaagcacaaagtacctcggccgcgaccacgc

SEQ ID NO: 44 - DNA, 549 bp, Trichoderma reesei
gcgtggtcgcggccgaggtacggggtccccagatttcttgttggcgaggaacccccaaaggatcaacagagcgtctttccagatcgctattcatagaatttttgtgtaacggggagctgatgccactcctcctcatgtcatcaagcgagtgcttcacacgcgaaaaaaaaatgcccccatcttcctcgtatcataaagggccgtcatgcctctattcatcggcccattttccatcaagcaatcaggtgcagatatcacaagggaaaggaaataaagaagccccccttcatgtggcctaccctctatcgtagcaatagagccacagtcaaggttacagcaccagggataacagcctcgtatcaaagtgaagatcccccggcacatcatcaacggaattttccccatgaggtatctcgaaagaaagggaccacacaagattgtgttacctcaccaatcccaccaatgctccatgggtcaacctaccactgtacctgcccgggcgccgctctaaaagggcgaattccagcacactggcggccgttactagtg

SEQ ID NO: 45 - DNA, 424 bp, Trichoderma reesei
gagcggccgcccgggcaggtagaccaacggtcaaaagctccagatagccgtctctctctctctctctctctctctctctgtcacttcttcttccctccgttctctcctcctcccatcttcacatagcaactcgcgcgactccctcaattgctcccgccgtctctccgccacttgtcgcatccctccctccttcatcctccacgcccaacaaaacgagtcgcatcgcaaacatgtcggtccccgaatccacatacttgcgatgcgactcgttttgttactcattccgattacaagacccaaaagagccctgtatcagtatttattgtcactacctccccgtgtcgggattgggtaatttgcgcgcctgctgccttccttggatgtagtagccgtttctcaggctccttctccggggtcgagccct

SEQ ID NO: 46 - DNA, 192 bp, Trichoderma reesei
gcgtggtcgcggccgaggtccgtggtaattctagagctaatacatgctgaaaatcccgacttcggaagggatgtatttattagattaaaaaccaatgcccctcgggctctctggtgaatcatgataactagtcgaatcgacaggccttgtgcggccgatgcctcattcaaatttcttccctatcaactttcg

SEQ ID NO: 47 - DNA, 384 bp, Trichoderma reesei
gcgtggtcgcggccgaggtcggccgaggtccatgtttggccaatacccaaacatcgaaagttgatagggaagaaatttgaatgagccatcgtcggcacaaggcctgtcaattcgactagttatcatgattcaccagagagccccgaggggcattggtttttaatctaataaatacatcccttccgaagtcgggattttcagcatgtattagctctagaattaccacggttatccaagtagtaaaagtattatccgataaacgctaacttatattaatggagcccattcgcagtttcgcgggataaattgcttatactttagacattctatgggctttaatcttttgagaacaaagcatatgactactggcagacctgcccgggc

SEQ ID NO: 48 - DNA, 538 bp, Trichoderma reesei
tccgagcggccgcccgggcaggtcagtagtatatgcttgtctcaaagattaagccatgcatgtctaagtataagcaattataccgcgaaactgcgaatggctcattatataagttatcgtttatttgataatactttactacttggataaccgtggtaattctagagctaatacatgctgaaaatcccgacttcggaagggatgtatttattagattaaaaaccaatgcccctcggggctctctggtgaatcatgataactagtcgaatcgacaggccttgtgccggcgatggctcattcaaatttcttccctatcaactttcgatgtttgggtattggccaaacatggtggcaacgggtaacggagggttagggctcgaccccggagaaggagcctgagaaacggctactacatccaaggaaggcagcaggcgcgcaaattacccaatcccgacacggggaggtagtgacaataaatactgatacagggctcttttgggtcttgtaatcggaatgagtacctcggccgcgaccacgc

SEQ ID NO: 49 - DNA, 540 bp, Trichoderma reesei
gcgtggtcgcggccgaggtgccagtagtcatatgcttgtctcaaagattaagccatgcatgtctaagtataagcaattataccgcgaaactgcgaatggctcattatataagttatcgtttatttgataatactttactacttggataaccgtggtaattctagagctaatacatgctgaaaatcccgacttcggaagggatgtatttattagattaaaaaccaatgcccctcggggctctctggtgaatcatgataactagtcgaatcgacaggccttgtgccggcgatggctcattcaaatttcttccctatcaactttcgatgtttgggtattggccaaacatggtggcaacgggtaacggagggttagggctcgaccccggagaaggagcctgagaaacggctactacatccaaggaaggcagcaggcgcgcaaattacccaatcccgacacggggaggtagtgacaataaatactgatacagggctcttttgggtcttgtaatcggaatgagtacctgcccgggcggccgctcga

SEQ ID NO: 50 - DNA, 531 bp, Trichoderma reesei
gcgtggtcgcggccgaggtacagattgacaaagggcgtgatgagcaggggcgtcacacaaataaaaagaaaaagaaaacaaggcgcttgtctgtttcgtctcgccatgcccacccattgcagaaaagacagtggaataaagagcgttgattgtgtgatattcgaggacaccatccattcccagttctaattctcgaacgctttgcacccatattcagaaagcaaaaaaagaagaaaagacgatagcgtggaagcgagagagtaaacatgtcgcatcatttcttccggcctttgggtggtttctgaagtggcgagtagtcctggacaaactctgcatcatccaagcactccgtaacgaccgggttgacaaagatgtggtgctgaagcccgcccttgaagataattctcataaagttcactctaaagtagagagaccagttgtcaaccttggcaacttgattgcccagcctcagcttgcaccggtaaccatactctgccgtccctcgtcagtacctgcccgggcggccgctcg

SEQ ID NO: 51 - DNA, 356 bp, Trichoderma reesei
gcgtggtcgcggccgaggtactcgggtcagcttgtctgtcactcggttggcgatgtaggcgcccgtcgttgttctggaatcgactcccagaatgactccatccttgaatgtcacagccatgatggaagtgccgaggttgacctctcccttcttcaatcgatccatatcgacatggatgccatcttcattcagcacgccagcacgcccaaactccatggttgcagatagtatgaagagtagagtgacggtgtttcgggggtatttgtcggtctcgagggaacaggaagtcgtgtgctggtagatggttgtcgtttgctgcttgtctgggaaggctggacctgcccgggcggccgctc

SEQ ID NO: 52 - DNA, 388 bp, Trichoderma reesei
gcgtggtcgcggccgaggtcttcattgcttcaaagatggcctcgaaagctttcttcgatcccgtggcagctttacgtgccgcccctctccttacatcaacctgctccctttggttcgcatgggatcagcacttcttcctgcacatcttcaacaagcccgaactccgtgcgaagagtaatgacttgctgccgacatactttcgctttttcttccgtggcggtgtcacccgcgtcctggtcctaatctcgctgacgctgtcttcttctttcgccacttgcttcgtcaaccatgattcgcattgggcgaatgggtctctacgctggtatacggctggcatggctttagcagccagccatcttgcctttgtacctgcccgggccggccgctc

SEQ ID NO: 53 - DNA, 442 bp, Trichoderma reesei
ggccgcccgggcaggtaaggggggctcatggagaacagaaatctccagtagaacaaaagggtaaaagtccccttgattttgattttcagtgtgaatacaaaccatgaaagtgtggcctatcgatcctttagtccctcgacatttgaggctagaggtgccagaaaagttaccacagggataactggcttgtggcggccaagcgttcatagcgacgtcgctttttgatccttcgatgtcggctcttcctatcataccgaagcagaaatcgaggcgaaggacggcttaccctcagcagatcgtaacaacaaggctactctactgcttacaggaccgtttcgcacagctaagtcgtctgcaaaggatttaaccccgctcgtgttgaaattacaatacgcgaaataccgcggcccgcttcgaggaccgacctcggccgcgaccacgc

SEQ ID NO: 54 - DNA, 472 bp, Trichoderma reesei
gagcggccgcccgggcaggtgcttcggtatgataggaagagccgacatcgaaggatcaaaaagcgacgtcgctatggacgcttggccgccacaagccagttatccctgtggtaacttttctggcacctctagcctcaaatgtcgagggactaaaggatcgataggccacactttcatggtttgtattcacactgaaaatcaaaatcaaggggacttttacccttttgttctactggagatttctgttctccatgagccccccttaggacacctgcgttatggttttacagatgtgccgccccagccaaactccccacctgacaatgtcttcaacccgggtcggcccgcgaaggaccttaataccagaagttggacgtaaatccagccccgcttcattgaataagtaaaaaaacaataggagtagtggtatttcaccggcgccgaagctcccacacctcggccgcgaccacgc

SEQ ID NO: 55 - DNA, 280 bp, Trichoderma reesei
ccttgagcggccgcccgggcaggtggctcatggagaacagaaatctccagtagaacaaaagggtaaaagtccccttgattttgattttcagtgtgaatacaaaccatgaaagtgtggcctatcgatcctttagtccctcgacatttgaggctagaggtgccagaaaagttaccacagggataactggcttgtggcggccaagcgtccatagcgacgtcgctttttgatccttcgatgtcggctcttcctatcataccgaagacctcggccgcgaccacgc

SEQ ID NO: 56 - DNA, 883 bp, Trichoderma reesei
gcgtggtcgcggccgaggtactaagctcaattaccattgcggtgaggtcatcagtagggtaaaactaacctgtctcacgacggtctaaacccagctcacgttccctattagtgggtgaacaatccaacgcttaccgaattctgcttcggtatgataggaagagccgacatcgaaggatcaaaaagcgacgtcgctatgaacgcttggccgccacaagccagttatccctgtggtaacttttctggcacctctagcctcaaatgtcgagggactaaaggatcgataggccacactttcatggtttgtattcacactgaaaatcaaaatcaaggggacttttacccttttgttctactggagatttctgttctccatgagccccccttaggacacctgcgttatggtttcacagatgtgccgccccagccaaactccccacctgacaatgtcttcaacccgggtcggcccgcgaaggaccttaataccagaagttggacgtaaatccagccccgcttcattgaataagtaaaaaaacaataggagtagtggtatttcaccggcgccgaagctcccacctattctacacctcctatgtcttttcacaatgtcaaactagagtcaagctcaacagggtcttctttccccgctgattctgccaagcccgttcccttggctgtggtttcgctagatagtagatagggacagtgggaatctcgttaatccattcatgcgcgtcactaattagatgacgaggcatttggctaccttaagagagtcatagttactcccgccgtttacccgcgcttggttgaattacttcactttgacattcagagcactgggcagaaatcacattgcgtcaacacctcggccgcgaccacgc

SEQ ID NO: 57 - DNA, 581 bp, Trichoderma reesei
gcgtggtcgcggccgaggtatgaaagtgtggcctatcgatcctttagtccctcgacatttgaggctagaggtgccagaaaagttaccacagggataactggcttgtggcggccaagcgttcatagcgacgtcgctttttgatccttcgatgtcggctcttcctatcataccgaagcagaaatcgaggtgaaggacggcttaccctcagcagatcgtaacaacaaggctactctactgcttacaggaccgtttcgcacagctaagtcgtctgcaaaggatttaaccccgctcgtgttgaaattacaatacgcgaaataccgcggcccgcttcgaggaccgcggaggaatcgcctgctgagacactaagccgaagcctattcttgtccgtctatacgtgcgggtgctatcaccgcgttctggcatggattctgacttagaggcgttcagccattatccagcagatggtagcttcgcggcactgcccggtcggacagccgcaaaaaccaattatctgaatgagcggttcctctcgtaccctgcccggggcggccgcttagaggcgaatttcacggcacacctgg

SEQ ID NO: 58 - DNA, 413 bp, Trichoderma reesei
tcgagcggccgcccgggcaggtgtcctaaggggggctcatggagaacagaaatctccagtagaacaaaagggtaaaagtccccttgattttgattttcagtgtgaatacaaaccatgaaagtgtggcctatcgatcctttagtccctcgacatttgaggctagaggtgccagaaaagttaccacagggataactggcttgtggcggccaagcgttcatagcgacgtcgctttttgatccttcgatgtcggctcttcctatcataccgaagcagaattcggtaagcgttggattgttcacccactaatagggaacgtgagctgggtttagaccgtcgtgagacaggttagttttaccctactgatgacctcaccgcaatggtaattgagcttagtacctcggccgcgaccacgc

SEQ ID NO: 59 - DNA, 333 bp, Trichoderma reesei
gcgtggtcgcggccgaggtagaacgcggtgatagcacccgcacgtatagacggacaagaataggcttcggcttagtgtctcagcaggcgattcctccgcggtcctcgaagcgggccgcggtatttcgcgtattgtaatttcaacacgagcggggttaaatcctttgcagacgacttagctgtgcgaaacggtcctgtaagcagtagagtagccttgttgttacgatctgctgagggtaagccgtccttcgcctcgatttctgcttcggtatgataggaagagccgacatcgaaggatcaaaaagcgacgtcgctacctcggccgcgaccacgc

SEQ ID NO: 60 - DNA, 388 bp, Trichoderma reesei
ttagcgtggtcgcggccgaggtacttgtagtttgcctcaactttggttagcaggtgtgaattgttcattggcttcgtcttccccttatatttatatcatgttcacacgcctcgcatcactaagctgtgtagtcactgacctttgatagcccaagccactactatcagccttcagatcatgacgctcccccttcgcatgactcacgcaatgccgctgatgtcggcgatgacaatgccatgatctccaccagacctgaagaaaagacgcaggcttcagagatcaacatatcctgcttgaagaacaaagtgacgtggagggatgtggacgaccgagcgcaacacagcgatcacgtcaaccttgatatgtacctgcccgggcggccgctcga

SEQ ID NO: 61 - DNA, 430 bp, Trichoderma reesei
gcgtggtcgcggccgaggtacataggcagtgaacctctttgttttcctctatcatttcgcccccaagttctacgtaaaactcccatgtctacgtctacacccctccacgtctctccccggatcgactttttactcagccagccaatcgaggacaaccttttgaaactgctcgggagcagacagctgaggcgcatggcccagatcgggaaactggtagagcgtgcagtcggggatctcgccgcagacctgagggccgaggacgtcaaagtggccgagcttggcggcgacctcgggcggagaccagttgccaccgatggcgacgtggtcctggtcgccgacgatgagcagcgtcttggtgacgacgtcgccaaagtagtgggagacgggctgggtgaggacgaggtcgacgatacctcggccgcgaccacgc

SEQ ID NO: 62 - DNA, 651 bp, Trichoderma reesei
tcgagcggccgcccgggcaggtacaaattgggggatcatgaagattttatcagtgagtatgtagactcggaatggcaaagatatatcttaaattatcagacatagaatgataaggttgtatgtcaaaagggaaacagcccagaacaagagttaaggttcctaaattatttgttaagtgaaaataagaaggtttttatttaagtcgacaaggagataggcttagaagcagccataattttatgacctcgtaacagagcgcttgttaaattgtaaaagcgtcgaaaatataacggatctaaacaatataccgaaaccttgtccataatatattataataaatatgtttattgtaattaaatggggtagcagaacgttgagctaaaatatgagttttattttttaaataaaattatagtaatttaactcaagtgagaatggtgacatgagtaactaaaagaaaattttccgccttaagcttatggatgtaattaagtaacggcctctaagtttatacaatctaaagatttaaacgatgagaaaatctttattactaaaaacaacattttagtgtaaaatgtgctggaaaaatagtaatatatttgttattaaataacaaataaaataaccgtacctgcccgggcggccgctcga

SEQ ID NO: 63 - DNA, 301 bp, Trichoderma reesei
ttagcgtggtcgcggccgaggtacgagctcggcagcgacacctttatccgcaaccacctgcgccggctctacgatgccctgctggagcagaatctcatcaaggtcattgagcccttttcgcgggtggagattgaccacatcgccaagatggtgggtctcgatacccagcaggtggagaggaaactgtcgcagatgatcctcgacaaggtcattattggtgttttggaccagggcgctggctgtctgagcatctatgacgagacacagcgggacgaggcgtacctgcccgggcggccgctcg

SEQ ID NO: 64 - DNA, 423 bp, Trichoderma reesei
tcgagcggccgcccgggcaggtacagagatgttttgcaagagtgctttgtcgtaaaagaggaataagggtatcgcacgagaggtccgctccgggaaaaaacagaaaggagaaaggaagcgtttcggtcgtgttgttgaggtcatgtagtataagggccagccttggatggttacttgggcggccggatggagagttcttgcggtgccatgtaatggtttgttttgtgtggtgctctgtcaattgagacgcctagtagtctcgacaagtccttgtgtgcagtcgtctagcacatggggcagtgggagcactgcttgtggccgcagcaagtgcaggtcgtgctgatgacaatcatgccaccgcattggtaacagtactgccctcttacataaaactctagtcaagtacctcggccgcgaccacgc

SEQ ID NO: 65 - DNA, 442 bp, Trichoderma reesei
gcgtggtcgcggccgaggtacaataaatgccagtttctcccatgtttcccaatgctccccaatctcctccacttccgctcttatttgttcaacggagtgtctatgatggtatttaatggacggcctgtgaagccgcgcagccttagaagctactcacagtttccaggttccttggaaaacttgtgttcgaggacatcgtccagggggcccttggggttggatgtgagattatcaagctggctcttggggtctttgttttctgacttgtcgtagttgggtcccttgccggatcctgtgggatcttggagctggcggccgctctggcgttcgggaggaggggattgacgtccttcaggcatgatggatggatgtgtctgtttgattaaattcggtggatgaaggtgatggtgatgttgttcttgacctgcccgggcggccgctc

SEQ ID NO: 66 - DNA, 490 bp, Trichoderma reesei
gcggtggtcgcggccgaggtgtacaagctttttttttttttttttttttttcttgtgtgacctctctcattgcccagtatgactcacgtcataccatccagtctatgtatatccatctatatcatcccgtccgggtatcatttttctataattccacaagaccaataatccctttaatctcacagagcacctcccaccatctttacaatccacatggcgatccgcaccttgaggctcaccctccactcatttctcgtaaagtcatccatcgtaacctttgccgcatggtcctgcagccagttttgctcctctcccaacctcgccttcaacgcttcgttccgagtcacaatcagagctccggcctcgagatcaagcgaatagcttctcttcgtatagttggagctgccaatgatgctcatgcagggattcgcgtcgccgggcatcgtgatccatagcccttttgcgtggtacctgcccgggcggccgctcg

SEQ ID NO: 67 - DNA, 442 bp, Trichoderma reesei
gcgtggtcgcggccgaggtcgcttctctcgcaaggcatggcgatactaatactagtggctttctctgcctcgacgtcaggctttgttctcctgcttgggagctctcggcggaattgatggcattactctgcccaatctcctggagtgtaaatgaccagcaagaacggccaacaacacttgagcaccggtcgacggcttcaatgaatggtcctgactttgctgctgcgtgcctagccaaaagagaccgagagggaaggggaaattctgcctcctcacgtccgcgcccacccctgcttgttcacgtgtgtcggtggctttcggcatggcccgctcagagacgactctctcctcttttcgactagcagtaccattaatacccaactccgaaagactggggtgcctaatgaaagaaaaaaatgcttgtacctgcccgggcggccgc

SEQ ID NO: 68 - DNA, 441 bp, Trichoderma reesei
aattcgccctttcgagcggccgcccgggcaggtgagaaacgaggaaaaatagaagaaaccaaaaaaagaacaataatcccgcgtccatgaggtcaatgagtcctggcgaacaaagacaacgcttttgcatcttctcactcttctcttgcgtgatgagcgacgcatctgccggatgaactcttcctcttccttttttctttctaaggtcttctttatgttctcctttccttctttttcgctgcatggactcgagtggaggtggcggtggatgtaaatttgggcgattgatcaaggaaggcggctggagcatgggacaaatggtgttatcgaaaagaaaagggaccccgactgcttttgattttcgcgccggaaattccgttaggggatctaggtggagggagtctcttgaaatgacattcctgacctcggccgcgaccacgc

SEQ ID NO: 69 - DNA, 222 bp, Trichoderma reesei
gagcggccgcccgggcaggttgctgaccagcctcttgttgctatacgtccgttagccctaccagcgatttactcgtgctatccgagccgctttcgcccgtagatcctcattttgtgcctcgctttccctctttgctgcctttgtgggtcgcgtttcctcgattcttttggcacctataattcctacggctcatcaatccgttcacctcggccgcgaccacgc

SEQ ID NO: 70 - DNA, 445 bp, Trichoderma reesei
tcgagcggccgcccgggcaggtacgtgcatgtctgtgtgtgcaaaagttcattcatcctcgtctcggtccgcatccctggggcgtgacaaccccgaagaagcaatccccggactgcttctgcacaatctgatcctcaaagatgggcgtgatgacaatgtctgccgcgacgagggagagcgctgtcgagaggagggtgaagaacaaggtcgtcttcatcttgatagatttatgggtatgtatcttcttttcgcttctcctgttgcaggaatagaatcggggtggtgattatcgtggtgagattactactgaaatagatggacgagctgcacagcagtcggtaggtagttaacagcaaaaccaaagcaaaaagaagcagaaacagaatccggaagtaaaaggggcaaaaaaaaaaatcgcaacctcggccgcgaccacgctaagggc

SEQ ID NO: 71 - DNA, 268 bp, Trichoderma reesei
gcctagagttttatgtaagaggggccagtcctgtttgatgaaactatataaagctgaaatcgagaacagacagcctcatagagtagctactatgtttgatagcgagatacaaacgttggcgaggcttctgcattcagctcagagtgctactttcttgcgagacacgagctgaccaaggatgtgtccgtccatgagttaccactgccagtcggtgtttccgtcaggacatacgtgctatcaaatgatccgacctcggccgcgaccacgc

SEQ ID NO: 72 - DNA, 829 bp, Trichoderma reesei
tcgagcggccgcccgggcaggtgcggaccgctgcctatcgaggcccaagttctcgtctcgtccccaaagaatggcaagagccagcagatcaccacggtctgccttacgggaaccccggaactggttaacaagagccgcgagaccatcttgaatgagattcccatatctatgcgatgtaccttaagccagccaactaagaagaggccaaggcgcaggccactgtcctctttttaacttgccggaggactaatttaggattgtgcgtggttcttcttggatatacttaataccaggattatcgcagtgtatgctatctgtcgtttcggtcagtatctcatggggtttgttgggagtcaatggtcgctaggcagtatctatgcaagcagtactacaaataacattgacggcgccttttctccgcttgccacttggctccgacagaacaatcgccaggctatcctgacagaaaccggtggtggcaacgttcagtcctgcatacaagacatgtgccagcaaatccaatatctcaaccagaactcagatgtctatcttggctatgttggttggggtgccggatcatttgatagcacgtatgtcctgacggaaacaccgactggcagtggtaactcatggacggacacatccttggtcagctcgtgtctcgcaagaaagtagcactctgagctgaatgcagaagcctcgccaacgtttgtatctcgctatcaaacatagtagctactctatgaggctgtctgttctcgatttcagctttatatagtttcaaaaaaaaaaaaaaaaaaaaaaaaagcctgcccgggcggccgctcga

SEQ ID NO: 73 - DNA, 463 bp, Trichoderma reesei
tcgagcggccgcccgggcaggtactgtttgatgaaactatataaagctgaaatcgagaacagacagcctcatagagtagctactatgtttgatagcgagatacaaacgttggcgaggcttctgcattcagctcagagtgctactttcttgcgagacacgagctgaccaaggatgtgtccgtccatgagttaccactgccagtcggtgtttccgtcaggacatacgtgctatcaaatgatccggcaccccaaccaacatagccaagatagacatctgagttctggttgagatattggatttgctggcacatgtcttgtatgcaggactgaacgttgccaccaccggtttctgtcaggatagcctggcgattgttctgtcggagccaagtggcaagcggagaaaaggcgccgtcaatgttatttgtagtacctgcccgggcggccgctcgaaagggcgaattctg

SEQ ID NO: 74 - DNA, 543 bp, Trichoderma reesei
tcgagcggccgcccgggcaggtactttgaggaggacgagaacggcggcaaccttgccccagccggccgggttatggaaatgctttcagagcacacctgtgagggatggctggagggctacattctcagtggccgtcacggcttgctgaacagttacgaaccctttatccacatcatcgactccatggccaaccagcactgcaagtggttggaaaagtgtttcgaggtggaatggcgtgtcagggtcgcctctctcaacattctcttgacatccgtcgtctggagattagattacaacggcttcacccaccaagaccccgggttcctggatgttgttgccaacaagagcccagaagttgtccgcatctaccttcctcccgatggaaactgcctgctttctgtcatggaccactgtctccggtcctcgaattacgtcaacttcgtcgtgttaaataagcaggagcaccttctgtacctccgccgccaccacgacaatgaggaattaattccagccccacttggcggcccgtttactaagtggatc

SEQ ID NO: 75 - DNA, 482 bp, Trichoderma reesei
tcgagcggccgccccgggccggtgtttggctggggcggcagctgttgtcacacttgaacaccttgaacctggagggcaccgaaaggcggtgggaagaaacgattaaatcatacgaggtgagcccaaggtcaagaggctgactctttaagcgcaagccggcgagaagaaaaaggtgaggaggaactgaaggtcagatccacacaagcacctcaaaatcctgccgatttggagacgaaactggggagccttgggtgaattggatcgagacaaagcgatggaagcccgtctacgattggcagtctcggaaaggagaaaaattttccttctcttttttccttcgtcgtctatccttctcgatttgatcgtctcgtgggtggccggagaacgaaaagggcgagaaaagaagcggttggcgagccaaagtgctgcaagaaattccttgtcgctagaggtaaggaattccacctcggccgcgaccacgc

SEQ ID NO: 76 - DNA, 398 bp, Trichoderma reesei
tgagcggccgcccgggcaggttgtttgcatcccttttcctccttcatccttcttctcagctctaccatctccctcatctcgaacaacatcgacacttcaattctcgatctgtcccgcgtcagccagcacgagagttgcaacgtcagccgacctctgtcgaatctccagcctcacctagcattcaattatccatatcttcactcctgacatcacaatgcctgctcctcaagtcaacggcgaggtgtcaaaccacatccactccgccttcctccagcatctgctctcgtatcccctggttagcgacagcattcacactgtgacctccaacgaactcgcgcaaaagtccatcaagctcggcgactctgcctatcgaactttcacctcggccgcgaccacgc

SEQ ID NO: 77 - DNA, 548 bp, Trichoderma reesei
tcgagcggccgcccgggcaggtacattgcgcttttcttctgcacctctctggtaggatctgagcaaatcggtggcgagctgctgcgagaacccttgatctccatccaaatcgacattctacacacgcaaggggccgacagcagccatttccttggcgacggcttcagtcgtcttgggccccctggtcgatgtttctggtcctcaagttcgttttcttgcactcccccctttccttaggttttgatgtttttcattctacccacacgcatcgctttatcttgatcttcgacgcatcttacattcacgacttgacgcatggctcggatggttctggattgacgggagggtgtttcttcgtggctggagtccccaacactccttctgaagcacccttccgtgattctagagaacatctgaacggcacgcgacttgtgtgatgtgacacgctagcgagccccacctggtgcccgcacaccccggcccgctttggatgggctcaccccaaggttttagaagatggcccgtacctcggcccgcgaccacgccta

SEQ ID NO: 78 - DNA, 273 bp, Trichoderma reesei
tcgagcggccgcccgtgcaggtaccgtcattagttgagcggtgctcgatgtgtagttgagagatttgataattgttgggaggaagagggagatgccatagaggggacagacgacactccagtatacgaagagattgacccagacttgccagtcagtaaaggcttgacgaacgtatttccattcaaactcttccgcctgtgcaacctgagcttgctcagtctccccgtcggccgaggtctggacttgaccttggtacctcggccgcgaccacgc

SEQ ID NO: 79 - DNA, 702 bp, Trichoderma reesei
taaagtggcagcaatgcagatgcttcaatatatcccaacgcagcctccagtatatgcccccgcattcgccgttttttgtagttgatgcggccctgtattgaccacaagtgaactgtctcaacaaagcaccgcttctttccgcttcgtgggcacgacaatgccaggagcttacacactagagaagaataggcagaagctggcagacgaatatgactttccacgggatctacagatggaattggggacgatactcaccaaaaagatatttgacgagaacaccgttggtgcaaatggtgaggcgctccagtgcttgagaaagggccaaggatggtcatgggaagcgtgcgatgactacgcggtgtttgccaagtccctagtgagcgctgaaagacagagacggcagttggaccccaattggcaagacagcatgaggctaaaagtgagggcatacttcgccgaaaccgacataatgattggcgcaggtggtcaacaatatatcgaggacattttgggatggaaagacaaggcattcgatgatgtgctggatttcgagtcggtcactgttcccggcactgaccatgacagtgttatgcagcctgttgaaattctggagcaggttttcatcgatgctggaggcagtctgcttcgttagtggggatgaccttcaatgagaagaagcatgtacctcggccgcgaccacgc

SEQ ID NO: 80 - DNA, 236 bp, Trichoderma reesei
gcgtgggtcgcggccgaggtaaattattgttaatattaatcaatcccgtgcaacttccactacacgaaccgtatttcgacttaacactaattagagccacacatacgaagatccctaataatagaatatataaaacctacttgttttttttactaattattaagaaagcaaacttattgcgcatgctcttttcagcatgtgacgagtggttagtacctgcccgggcggccgctcga

SEQ ID NO: 81 - DNA, 244 bp, Trichoderma reesei
tcgagcggccgcccgggcaggtactcctcatccacgaaataagaggggttcatgacgactgggttctgatttcacatctgaaaacttgggttttgtttgcgtgactttagtgtctttactcgagacgatgggtgactgtgtttcgcctttgggatctcttaatgcgttacggatggtttgctttatgggggcaatgtcttcacggtcaatggggttcgcggttgtacctcggccgcgaccacgc

SEQ ID NO: 82 - DNA, 284 bp, Trichoderma reesei
gcggccgcccgggcaggtaccgaggttggtcaccaggttggcaagagagtcaggctcaataaccaggagggtccggatatcggaatattccacgacaatttgacgaatggtgtcgatatagttcttatatttgacgacgccaccatcggcaatagagtattcgccattcgaggcaagggcagcgcaatcgcgatccggcaagtcatacaccacaaactgtccggcatagttaccgccattcttgttggcggtgcggatgtcggccacctcggccgcgaccacgc

SEQ ID NO: 83 - DNA, 459 bp, Trichoderma reesei
gcgtggtcgcggccgaggtcttttgttggggtcactccttgggccaatgcatattacgcctctgaagttagcagcctcgctattcctagcttgactggagccatggccactgctgcagcagctgtcgcaaaggttccctcttttatgtggctagatactcttgacaagacccctctcatggagcaaaccttggccgacatccgcaccgccaacaagaatggcggtaactatgccggacagtttgtggtgtatgacttgccggatcgcgattgcgctgcccttgcctcgaatggcgaatactctattgccgatggtggcgtcgccaaatataagaactatatcgacaccattcgtcaaattgtcgtggaatattccgatatccggaccctcctggttattgagcctgactctcttgccaacctggtgaccaacctcggtacctcggccgggcggccgctc

SEQ ID NO: 84 - DNA, 501 bp, Trichoderma reesei
tcgagcggccgcccgggcaggtacctccagtcggatcgggaaccgctacgtattcaggcaacccttttgttggggtcactccttgggccaatgcatattacgcctctgaagttagcagcctcgctattcctagcttgactggagccatggccactgctgcagcagctgtcgcaaaggttccctcttttatgtggctagatactcttgacaagacccctctcatggagcaaaccttggccgacatccgcaccgccaacaagaatggcggtaactatgccggacagtttgtggtgtatgacttgccggatcgcgattgcgctgcccttgcctcgaatggcgaatactctattgccgatggtggcgtcgccaaatataagaactatatcgacaccattcgtcaaattgtcgtggaatattccgatatccggaccctcctggttattgagcctgactctcttgccaacctggtgaccaacctcggtacctcggccgcgaccacgc

SEQ ID NO: 85 - DNA, 502 bp, Trichoderma reesei
tcgagcgggccgcccgggcaggtaccgaggttggtcaccaggttggcaagagagtcaggctcaataaccaggagggtccggatatcggaatattccacgacaatttgacgaatggtgtcgatatagttcttatatttggcgacgccaccatcggcaatagagtattcgccattcgaggcaagggcagcgcaatcgcgatccggcaagtcatacaccacaaactgtccggcatagttaccgccattcttgttggcggtgcggatgtcggccaaggtttgctccatgagaggggtcttgtcaagagtatctagccacataaaagagggaacctttgcgacagctgctgcagcagtggccatggctccagtcaagctaggaatagcgaggctgctaacttcagaggcgtaatatgcattggcccaaggagtgaccccaacaaaagggttgcctgaatacgtagcggttcccgatccgactggaggtacctcggccgcgaccacgc

SEQ ID NO: 86 - DNA, 362 bp, Trichoderma reesei
gcgtggtcgcggccgaggtaccattactttcattactatgtagaatccatgcctcgttctggtatattatcttgtataaccttaccctcattaaagctgcgcccagcttcctcgcaccccctcacgcggcctggtaaacctggaacttgcccacttcccagtaagcatcgacaaaggactgggggttgtttgcaactatatcggtgcagttgctggaacagccagagctatcccacacgccatacaccaagtcgccgcagaggtcaatgttcaggataatcgagttgttcctaaagtgactcccgacgttacaatccgtgctcgggaaatccgccgccgccacctgcccgggcggccgctcg

SEQ ID NO: 87 - DNA, 425 bp, Trichoderma reesei
tcgagcgggccgcccgggcaggtgtcgtcttcgtatgcgagtgttcgggtgtcaaacccctacgcgtaatgaaagtgaacgcaggtgagagcttcggcgcatcatcgaccgatcctgatgttctcggatggatttgagtaagagcatacggggccggacccgaaagaaggtgaactatgcctgtatagggtgaagccagaggaaactctggtggaggctcgcagcggttctgacgtgcaaatcgatcgtcaaatatgggcatgggggcgaaagactaatcgaaccttctagtagctggtttccgccgaagtttccctcaggatagcagtgttgaactcagttttatgaggtaaagcgaatgattagggacccgggggcgctatattgccttcatccattctcaaactttaaatatgtaagaagcc

SEQ ID NO: 88 - DNA, 579 bp, Trichoderma reesei
tggtcgcggccgaggtactaacgccttttgtggtgtctgatgagcgtctactctggcaccttaacctcgcgttcgggtcatcccgcatcgcagttctgcttaccaaaaatggcccactagtgttgatacattcgaatgcccacgttcaattaagcaacaagggcttcttacatatttaaagtttgagaatggatgaaggcaatatagcgcccccgggtccctaatcattcgctttacctcataaaactgagttcaacactgctatcctgagggaaacttcggcggaaaccagctactagaaggttcgattagtctttcgcccccatgcccatatttgacgatcgatttgcacgtcagaaccgctgcgagcctccaccagagtttcctctggcttcaccctatacaggcatagttcaccttctttcgggtccggccccgtatgctcttactcaaatccatccgagaacatcaggatcggtcgatgatgcgccgaagctctcacctgcgttcactttcattacgcgtaggggtttgacacccgaacactcgcatacgaagacacctcggccgcgaccacgc

SEQ ID NO: 89 - DNA, 384 bp, Trichoderma reesei
tcgagcggccgcccgggcaggtactatgtcgtgcaggaggcactgtaatctcccaggaactttgcagatgggagaacggagagggaaattcatcaacggataatagaaactggggcgaggcttttaccgaggccggctccagggcatctttggggacttttgggcgatggctgggtaggaggcggaatggagtaacggaggttcggcgatggaaccagacgaggagaagaaggcgttttatgtgctctatgcgcgagcggtctgtgcatgtgtctatatcgataccggggcaatggggcaatgggcaagggacacgcatgctttcttgaatagatacgaggggtgttttgcagcataccttgaagtagaggaaaaggattgcgg

SEQ ID NO: 90 - DNA, 750 bp, Trichoderma reesei
gcgtggtcgcggccgaggtacaagcttttttttttttttttttttttttttttattttttcgggaacaatgtttctcattgtaccaatccaaggttaattcaccgtgacatggtgattcacgattactagtaattacttattcatatagtcgaatttcagactacaatccttaaaatttatatcctgttttttgagattagcttaaattcacatttttgcatctctttgtccaggcatatgtggcacgtctatagcccacaatatcaaggccatgatgacttgtctttgtcccctttttctttccaaattccaggatcaaatgctttatcgtaaataaaaaaaaaataaagccagggattacgttaattacatggaaaccacagtttcacaacattaactgaaaacagcgtgcactcctgtaatatgattatacaaattgtggtaaggtttttcgtggatcatcgaattaaacaacatacttcactactggtgtcagaaacggtctagtgatttcagttcctgcgttgccacattactcttgaggtgaaatgcttacacttttcatttatagaccagataatgtttaatatttaatttttaattataatactaaatcttaatctaacctatggcattcatcatttactgcaaagactacttgggtatctaatcctgtttgtgctctgtgccttcgtcctttaacgtcagtttttacatagaaggctgcacctgcccgggcggccgctcga

SEQ ID NO: 91 - DNA, 743 bp, Trichoderma reesei
gcgtggtcgcggccgaggtaccaatccaaggttaattcaccgtgacatggtgattcacgattactagtaattacttattcatatagtcgaatttcagactacaatccttaaaatttatatcctgttttttgagattagcttaaattcacatttttgcatctctttgtccaggcatatgtggcacgtctatagcccacaatatcaaggccatgatgacttgtctttgtcccctttttctttccaaattccaggatcaaatgctttatcgtaaataaaaaaaaataaagccagggattacgttaattacatggaaaccacagtttcacaacattaactgaaaacagccgtgcaactcctgtaatatgattatacaaattgtggtaaggtttttcgtggatcatcgaattaaacaacatacttcactactggtgtcagaaacggtctagtgatttcagttcctgcgttgccacattactcttgaggtgaaatgcttacactttcatttatagaccagataatgtttaatatttaatttttaattataatactaaatcttaatctaacctatggcattcatcatttactgcaaagactacttgggtatctaatcctgtttgtgctctgtgccttcgtcctttaacgtcagtttttacatagaaggctgccttcgcctttaccgagtccctttggtatcatagaatttcatctctcctcctcaagtacctgcccgggcggccgctcga

SEQ ID NO: 92 - DNA, 458 bp, Trichoderma reesei
taccaatccaaggttaattcaccgtgacatggtgattcacgattactagtaattacttattcatatagtcgaatttcagactacaatccttaaaatttatatcctgttttttgagattagcttaaattcacatttttgcatctctttgtccaggcatatgtggcacgtctatagcccacaatatcaaggccatgatgacttgtctttgtcccctttttctttccaaattccaggatcaaatgctttatcgtaaataaaaaaaaaataaagccagggattacgttaattacatggaaaccacagtttcacaacattaactgaaaacagccgtgcaactcctgtaatatgattatacaaattgtggtaaggtttttcgtggatcatcgaattaaacaacatacttcactactggtgtcagaaacggtctagtgatttcagacctgcccgggcggccgctc

SEQ ID NO: 93 - DNA, 745 bp, Trichoderma reesei
gcgtggtcgcggccgaggtacttgaggaggagagatgaaattctatgataccaaagggactcggtaaaggcgaaggcagccttctatgtaaaaactgacgttaaaggacgaaggcacagagcacaaacaggattagatacccaagtagtctttgcagtaaatgatgaatgccataggttagattaagatttagtattataattaaaaattaaatattaaacattatctggtctataaatgaaagtgtaagcatttcacctcaagagtaatgtggcaacgcaggaactgaaatcactagaccgtttctgacaccagtagtgaagtatgttgtttaattcgatgatccacgaaaaaccttaccacaatttgtataatcatattacaggagttgcacggctgttttcagttaatgttgtgaaactgtggtttccatgtaattaacgtaatccctggctttattttttttttatttacgataaagcatttgatcctggaatttggaaagaaaaaggggacaaagacaagtcatcatggccttgatattgtgggctatagacgtgccacatatgcctggacaaagagatgcaaaaatgtgaatttaagctaatctcaaaaaaacaggatataaattttaaggattgtagtctgaaattcgactatatgaataagtaattactagtaatcgtgaatcaccatgtcacggtgaattaaccttggattggtacctgcccgggcggccgctcga

SEQ ID NO: 94 - DNA, 427 bp, Trichoderma reesei
gcgtggtcgcggccgaggtacggctcaaggacctgggatgcaacgttgataatctgataggccgcccgggccagcgaaacggtctctgggcgcagacggatggacgatgtctcggacacgatagaatacgtgatagggccaactgtaagagcatagactaggagccagaagatgcataacgctgcttctgcccatatggcatccttggcagatgtcgcagagttgacaatcccaatgataaggagagtggagcataagataccttgccccacaacatagagcgttcggcggccaaagtgcgtgatcaggaaccaagacaacaccgttccgagaaaagcgatagccgtgcccccgagattgagctgatatgcgtggtcagggctcattccagctgttgtgaagaagtacctgcccgggcggccgctcg

SEQ ID NO: 95 - DNA, 372 bp, Trichoderma reesei
gcgtggtcgcggccgaggtacttcttcacaacagctggaatgagccctgaccacgcatatcagctcaatctcgggggcacggctatcgcttttctcggaacggtgttgtcttggttcctgatcacgcactttggccgccgaacgctctatgttgtggggcaaggtatcttatgctccactctccttatcattgggattgtcaactctgcgacatctgccaaggatgccatatgggcagaagcagcgttatgcatcttctggctcctagtctatgctcttacagttggccctatcacgtattctatcgtgtccgagacatcgtccatccgtctgcgcccagagaccgtttcgctggcccgggcggccgctcga

SEQ ID NO: 96 - DNA, 422 bp, Trichoderma reesei
cgagcggccgcccgggcaggtacatgtcaggcagccatgctttcgtaaactgcctcctccagacacttgtagagtaattttagaaccgccatcggcatagtcgtcgttgtctccagtagccgcaaccagctgagtcgtccggcaacggtgtcaagtgggtttcaagaagaatgggtcttcttggacatggagaacgttggagtcatttcataagcgtcaacatgttcggacgcgaacttgcgggcagaaatcctctttgcgaataagatgtccagctcttcatacgttcgtcctttcgtttcgggaagtcggaaataggcccaaataaacatgatcagagcggtgccgccccagaagaaccccgtctttccagacgcgttccaagcggtcgggttcataaagtacctcggccgcgaccacgc

SEQ ID NO: 97 - DNA, 319 bp, Trichoderma reesei
gcgtggtcgcggccgaggtacgcatctcagtcgagggtgtggttcggcatcatgaatgagccccacgacgtgaacatcaacacctgggctgccacggtccaagaggttgtaaccgcaatccgcaacgctggtgctacgtcgcaattcatctctttgcctggaaatgattggcaatctgctggggctttcatatccgatggcagtgcagccgccctgtctcaagtcacgaacccggatgggtcaacaacgaatctgatttttgacgtgcacaaatacttggactcagacaactccggtacctgcccgggcggccgctcga

SEQ ID NO: 98 - DNA, 317 bp, Trichoderma reesei
gagcggccgcccgggcaggtacgcatctcagtcgagggtgtggttcggcatcatgaatgagccccacgacgtgaacatcaacacctgggctgccacggtccaagaggttgtaaccgcaatccgcaacgctggtgctacgtcgcaattcatctctttgcctggaaatgattggtaatctgctggggctttcatatccgatggcagtgcagccgccctgtctcaagtcacgaacccggatgggtcaacaacgaatctgatttttgacgtgcacaaatacttggactcagacaactccggtacctcggccgcgaccacgc

SEQ ID NO: 99 - DNA, 307 bp, Trichoderma reesei
gcgtggtcgcggccgaggtacgactacgatatatgatcttcttccatcatctctcttcggcatttagcgactggcatgggctttgggtatttggcacggcgtttctgatctggttcttttctacatgatacccccgataagggaaaatataaaaaggcacacggcgtttatcttgttttacagctttttcatttgttcaatatacaccacactagagattcacagctcactgtcttttctttgcgttcttcttacaaatgtcatggcaatgcgatggacgggaatgggtacctgcccgggcggccgc

SEQ ID NO: 100 - DNA, 365 bp, Trichoderma reesei
cgcccgggcaggtacggacatcagcatcaacgtcatcttcggtaaacttgctgatgcgaatctcaaacggctccgggatgctcatgacagtgtggcgtccatcatggtgatatctgaactcaaagacaccttgcgtccaccacagcttgtctccctggaaaacaacctcgccctccaccatgtcagggtctgaaggatcggccttgggcactggatgttccggaacagtaatgctagtctccgctgtcgaggcatcgtaggcgccagtgcatgtgggcgtccatctaccgagagaggagacttccgtcgtttctcgagagcgattgtccgtgaccatgtacctcggccgcgaccacgctaagggc

SEQ ID NO: 101 - DNA, 459 bp, Trichoderma reesei
gcgtggtcgcggccgaggtctggtttccaagctgattcccgaagttatcggccgcgaaatcgagaagtccacccagggcatctaccccctccagaacgtccacatccgcaaggttaagctgctgaaggctcccaagttcgacctgggcgccctgatggctctccacggcgagtctggcaccgacgaccagggccagaaggttgagcgggagttcaaggagcgtgttttggatgaggtctgaaaaaagggtttatgtgtagagagatgagaggcgcggggaagccctgcgagtagattcgcgcctagacgttttcccagtcattttacatggagtaacaacccataggcgggtagggaggtaggtaatgtccctatgatatattaaaaaacactcggattgcttcgaaaaaaaaaaaaaaaaaaaaaaaaaagcttgtacctgcccgggcggccgctcga

SEQ ID NO: 102 - DNA, 447 bp, Trichoderma reesei
cggccgcccgggcaggtaccgttacttgtgaagaaatagagaggcaatacatgtggtttcgtagttatctaccatgccttcctttgctcagggcattgccctagctctgacagtaacattaaagttgtttggtttgacaaaccagtagttcgttgtcttccactccctctccttgtcttgtagctcgaagtcgaagtttctgatcagcaatgggatgagctttggcatttccaaataagaaatgtgtcggccgatgcatgtccgggatcccaagccaaatggtaggtagtatgcagtcatctgggccaacttgcgtccaccctcctcttcggcctccagccatcgctctggccggaattctgcagcatcatccccaaagacatctttgttgtaatgtgctgtccatgtatttagaccgattgaagtacctgcccgggcggccgctcg

SEQ ID NO: 103 - DNA, 420 bp, Trichoderma reesei
tcgagcggccgcccgggcaggtaccggactgggcctgggcaatgacatcgtggcccttgataacgggcatgatggcgcgctgctggatagcagagggacgctcgaaaccgtaggcgtaaacaccacggaggagttcagacttgaggttcatgtcatcaaaggagtcgacagtctcgtcgtagttagactcgatctgtccctcggggacatcctcaagtcctttgtcagccatgattgcggttgtcgaagaagaaatctagatcaagcacagctcgacctagaaatagaagaaaaattcggcggggtggaagcgcggagaaaaaagacaggcatctcgggggagaaggctgcaggcggtgaatgaaactgaaggaagttgtcgtctagaccaaacgctctcgacctgcccggcgcccgctc

SEQ ID NO: 104 - DNA, 300 bp, Trichoderma reesei
gcgtggtcgcggccgaggtctgcgtccttcttcttcagatatttaatccatttctcggccgccagcgctccgttgccatcttcactgtattcacttctccatttctccagtctgcttccattctccgcctttcattaaatcgcagcagagggctctactttggcggcgtcacgcgatcgttccggccttctcctaagaccacacactcaatccttaatcctctcaccaacgtcaacaccatggccagtaaagcggcgcacaagcggttgacgcgagagtacctgcccgggcgcccgctcg

SEQ ID NO: 105 - DNA, 555 bp, Trichoderma reesei
gagcggccgcccgggcaggtacaagctttttttttttttttttttttttttgcggttatatgtagaattattaatattactatgtgggtaaaggtatatagtcggtatggaatgttttctatttcgtaagatcagtggcttcatgtaaaagacaaccaagggcaaaagagccatacagcccgtggaagggcatgttcaagtcgtgtatcagatggccttgttcgttgatttccgagtcatgatcttcgtgatagcatgtcgaatcgtaatgcctgccttttcaatgtcctttttggagagcgcagaagtgacgcacactttgagggctggctggagtgcccagtctccatccttggccgccattgcattcgcatatggcctagtcttcaatcgggtgatcaggacaccatttgcgagacactcttcgacgcaatccatcaagagtctctcttgatcatccaccgtcaatctctttcccttgataacctcgggcttgagcactagaagcaaaatagggacctcggccgcgaccacgctaagggcgaattctgcaga

SEQ ID NO: 106 - DNA, 481 bp, Trichoderma reesei
tcgcccttagcgtggtcgcggccgaggtacaccacatacttgaagcattgagaatctagcctacatcattgtcccacagcaagaagcccattgcccaatgcttgccatcaattctggctaaactgcacaccaatgtcaatgtagtaaaaattggggtcacctgtggccggaggagtgaatgtcttgatggcctgttcattcacaatctgttcccccgttgggctagtcagacgaattccaacaggcaagttaaagggccctgatccctgtgggattacccaactgccatagcgttcttgtgggcggctactcgtatagtttgggtcatggaccaaggcaacccagttgtcggtgtctgcgcccttgatctcgattttggtgactgagcccggtccgttggtgttgactgccgtgagagcaaaatagtaaggccctccgccatttcgaagccaaatgtagacctgcccgggcggccgctcga

SEQ ID NO: 107 - DNA, 708 bp, Trichoderma reesei
gcgtggtcgcggccgaggtcggccgaggtacaccacatacttgaagcattgagaatctagcctacatcattgtcccacagcaagaagcccattgcccaatgcttgccatcaattctggctaaactgcacaccaatgtcaatgtagtaaaaattggggtcacctgtggccggaggagtgaatgtcttgatggcctgttcattcacaatctgttcccccgttgggctagtcagacgaattccaacaggcaagttaaagggccctgatccctgtgggattacccaactgccatagcgttcttgtgggcggctactcgtatagtttgggtcatggaccaaggcaacccagttgtcggtgtctgcgcccttgatctcgattttggtgactgagcccggtccgttggtgttgactgccgtgagagcaaaatagtaaggccctccgccatttcgaagccaaatgtaggcgttcccaactttggggcattggactcttctatatcgagtcgggatgacgccattggttagtgatccattgccctgcaaacggcccatggcaatgtctgacaggtcgagatgaatgctgtcagcaggaagaggacagccgtatttgaagccgatctctccgcaatgatcggcgcccggaccacctgcgagatgttagccagggccattcggttggcgcatgtagtacctgcccgggcggccgctcga

SEQ ID NO: 108 - DNA, 360 bp, Trichoderma reesei
cgagcggccgcccgggcaggtgagacatctggccattattaaggcggctggtctctgaccagcttctgggaactggacaaggttttgtcgactctcatttgatgctctcctttcttattatacacagccatttgatgggctgacctggggcaactttggggcattggactcttctatatcgagtcgggatgacgccattggttagtgatccattgccctgcaaacggcccatggcaatgtctgacaggtcgagatgaatgctgtcagcaggaagaggacagccgtatttgaagtcgatctctccgcaatgatcggcgcccggaccacagcaccacttggagacctcggccgcgaccacgc

SEQ ID NO: 109 - DNA, 248 bp, Trichoderma reesei
cctttaacttgcctgttggaattcgtctgactagcccaacgggggaacagattgtgaatgaacaggccatcaagacattcactcctccggccacaggtgaccccaatttttactacattgacattggtgtgcagtttagccagaattgatggcaagcattgggcaatgggcttcttgctgtgggacaatgatgtaggctagattctcaatgcttcaagtatgtggtgtacctgcccgggcggccgctc

SEQ ID NO: 110 - DNA, 276 bp, Trichoderma reesei
gcgtggtcgcggccgaggtaccctcgcccgatgtgacccgtttgtcaatgcgagaccgcattgttgccttatctttcgaccgctcttgtggctcgcaagattgcctcttcccatacagaaatgtcggggtttccatttctcgaattgcgttcgtccaaggctgtgaccgaatgagacgcagccgacgggtcgaatcatattgcctcacttcacaagagaacaaagatccctgctcgatcccagctgttaatatgtacctgcccgggcggccgctcg

SEQ ID NO: 111 - DNA, 452 bp, Trichoderma reesei
ggccgcccgggcaggtactctggaacggagaccacgtatatgagggcgttcccgacacaatcgccctcctcaaatcaaaggcaaaaagtcgtcttcgtgacaaacaactccacaaagtcacggcaagactacgtcaaaagcttgaaagctctgcattctcagacgaacccgaagaagtcttcgggttcttctaaccaagccgcatctacatctaaccgatccccaaactgtccccccggaagaaacagggcttttttcactgggaaaaccgcaatcagaaagggattggcctcttcaagggaaatccccttcatcggcggcacggaccccggcttcaggagggaaatcacgccagccgactttgagggcatcgcaaacggctcgctgctggacccggaagtcggcgtcgtgctgtgcggcctcgactttcacgtcaactacttgaagcttgc

SEQ ID NO: 112 - DNA, 610 bp, Trichoderma reesei
gcgtggtcgcggccgaggtacttataacttaagagcaatatactttattaaaaaacaattaggcgtaggttcagtttacatagattctgattgtaataaagcagattttagaataagagatagaaaaagtataggttctaagattatacctatatttgataaatatcccttattaactagtaaatatttttcatatcaagtatttaaaaaagcttatgaaatactagaaaatcctaatttatctacaaaagagaaagataacctattactaaatttaaaaagtgaacaaatgcctatggattatatatctcctgcttgagaggcagtaaattatgaggttaataatactaatgatgctaaatcaataatgagtaagtattgacttataggttttactgaagcagaaggtagtttttaccttgtaagtaaaacttcaactcgtatagttcatgcatttgaaataactcaaaaattagattctatcgttttaaaagccatatctcttatattaggtataaattttgctaaaaaaacaacatattatacagtagtgactaccaattcacgtgctatttctaatataatagattattatagtaaacctatgaaa

SEQ ID NO: 113 - DNA, 244 bp, Trichoderma reesei
gcgtggtcgcggccgaggtacatcaacttacaaacgctcaacacgtcatattggcggcaaggaaacatatgaactgggtttcagtgtcggcttccagccttacttctcgctgagccccaagtattctttggagcgtgacacaagctccgagatcgtcgacgctatccgtgtcacaggccagccgtttgtcatgagccccgaccgcaaccgaccagattctgtacctgcccgggcggccgctcga

SEQ ID NO: 114 - DNA, 363 bp, Trichoderma reesei
gagcggccgcccgggcaggtactacttgaacgatctgtgcgagatcagatacaacgaacttatgatgctcgtgctccgtccgaaccccgtgttccagaagccaacaaaggcatccctatgtgaatgcttcagcagtgccattgcctgcagcaagctttacgccaaactttacgccgagaaccagctgcgatatggatggctgactgttcactcactgttcctgtgcatcatgaccatcttctactgcgtctgaacacccgacggtattgctgatcaggtcaactttgattgcctgaccacgtctttgaaggcggcgtcggatattctcagtgcgacgggagagtacctcggccgcgaccacgc

SEQ ID NO: 115 - DNA, 543 bp, Trichoderma reesei
gcgtggtcgcggccgaggtacttctattcgcctcgagacagaaaagcctctttttctagactgcgccctctggaatgttcgcccatcaagctatgtggcttgaaccggcgataggggtatcttctcagcatctagagctctgtagttgtgagggagatgatgttgtggcttgctggtagcctcaacttctccaattcaccaggctaatatgcggggaactatgacctttgaccaacgcactggttgaaccaagaagcaggatacaacggccaatcggtgttcaggttgtctcttccacgagctcggtaatgttgcgtcttgtccaactcgtcagatatctcgattgttgaacgatgagcggagctggcccggcgaacagtctggcgccactcggcaaacatgccttttcacagccgtggggttgcatcatcacgcacgtagatttgggcgttgagagggttacgctgtgatacggctccagttactctgactcaaaaacgtcacttcccatgtgtataggctttacctagtcaatagcaagcc

SEQ ID NO: 116 - DNA, 221 bp, Trichoderma reesei
gcgtggtcgcggccgaggttggccgcacgcacgactatgggtattatcatcgcgtcttcacggccgggctcggttttgtctgatgacctagcccacgacggcggtgacaatcggggacaaagtctaggcccctggatgcgggctgatacaatcacacaaggatggttattgatggaaatttgggggttttacgggtggtacctgcccgggcggccgcctcg

SEQ ID NO: 117 - DNA, 413 bp, Trichoderma reesei
tgagcggccgcccgggcaggtacgcgcctatccccagcctgaaccccacaaagaacaggcagtttgtggtgagcaccagcaaaatcacacccgagatggagcgcgccaacagagaggcgttttggtttttgtacaagctacatttttattttttttttttcttctcccgagagtaattagaagattcatttagaatgtctcagcttttagctagaataaaagtcattgtctcgttacatgtgttgtcgttgttcatctaccagtgctccccaataagtgccatacttggaacgcccagagacgacgttttagaaactcgcgcgctatatatgaggctgttatgtttgaaggatgcaactcatcataccaaagatagggaatcgaggcgtcccggcccatacaaacagtttgtt

SEQ ID NO: 118 - DNA, 363 bp, Trichoderma reesei
gagcggccgcccgggcaggtacataatcaagaataaaagctttttacaagttggtgcttcttccacgaagcaaatgttggcatgacgcgatctctcagatgatgaggcaggctaaggagtcattccagcgccttcaggaaaagacattactgctctgcatcacgccttgcggaccgtatgtgcaaagggggacgagtgtcaacatatggttggactaggctcgtctcacgtccagtttcttcaagtcatatgttccaggaccgggaagatgtctgcaaattggatagtttttctttcgtagctgccctcgatcaacctgggacgcgatacgcctcagttcaagtacctcggccgcgaccacgc

SEQ ID NO: 119 - DNA, 405 bp, Trichoderma reesei
tggatgtcttctgaagcggaggagatattgtccatttacacaaaatctacatcttgcaccctcagaatgaccatgcatgtaagccttcaacaagagaagtgattacagatgccaaagatgataggaaatgtcgatgtcaatcggggaaggaagttccccatacgtcaacacgatctcggcagggtgttaatactgaatatggccatcgcgttgacaaagaagcttgagaccctcttttcttggaaaccccaatggacgctgatatcggcttttgccatctcttcgtcttcaagagtcatggaaaagtcgcaggggagagccgcgtaggtatgtttttggtatatcgggaagccctctttcctgaatatctaagtgtccgacgaagtacctcggccgcgaccacgc

SEQ ID NO: 120 - DNA, 240 bp, Trichoderma reesei
gcgtggtcgcgccgaggtactggctatcaggctgttgttccttggcaagagtatgctcaaagacttgatggaatcgaaatggcgatgagacgttcgaatcgcagagtgaagattgagcaggggggcaagaggagactagtataaatacaggctccgaagataggaaatagaaggtgaagtattctcaagacgccgttacgctgcgttcgagacgggtacctgcccgggcggccgctcgaa

SEQ ID NO: 121 - DNA, 389 bp, Trichoderma reesei
tgattcgccttgagcggccgcccgggcaggtactttttttgcttcccctctgcagataaataaataaaaatacctatacactcccagacaagaagaggcggaacaatgcaaagaaaaagaaagggcagaagagatatcaaagccgtcagctctcgctctccgccttgccctttttgccctttgacctcttcctcttcttcctcgtcccgtcaacatccccaatgatgttattactctcctccttgtccccatctttgctcttatccttgcccttgtccttactactcctcttcttcttcttgctgtgatgatgctcctccgcagcctcatccgcaccaaccagcttctcaaacccatacgtcggccccgtacctcggccgcgaccacgc

SEQ ID NO: 122 - DNA, 459 bp, Trichoderma reesei
gcgtggtcgcggccgaggtcccagatctccaagcccaagaagaccgtccagcgcgcctacggtggttcccgatgcggtggctgcgtccgtgaccggattgtccgcgccttcctgatcgaggagcagaagattgtcaagaaggttatgaaggagcaggaggcgagccagaagaagaaataaacaaacatttttttcccaccactagacaaaaaaatatttcgactgatggacttggctttctgtgcgggatggcaaggaactcttgggggtttggttcattgctttggtgttcattagggcaaaaacggactgcatgatacattatggccgagccgacccatggccggtctgctgctgtctttaggactgcttcctcttggtgatctaatggaacgaacatcaagttggaaaaaaaaaaaaaaaaaaaaaaaagcttgtacctgcccgggcggccgctcg

SEQ ID NO: 123 - DNA, 194 bp, Trichoderma reesei
gcgggcaacgaccatgtagaggccctttgcgcatgtcgttgccgctgttgagctggcggcgagcagcgagagggagagggggagggagagtgagagggcgcgcatgatgagtgaccggttgtgatcctttgtcgtcgtcgtttctgtagtcaaaatactagattgtccttttgatacctcggccgcgaccacgc

SEQ ID NO: 124 - DNA, 615 bp, Trichoderma reesei
gcgtggtcgcggccgaggtacgtcttccagccaatcttgtccatggacacgggccatgcaaactggttcaggagtccagcagcgttggtggcaaagctggaaaaggccatgcccttggcgcgcatctcaaaggagagcacctcgacgggatacagggcctgcagaggagtgatgcccacagagtagacggcaccaaagatgaagatcatggccagggcagccttggaagcgctggggttgctgtagatgggatcgccgttggcgtcatttccgatgaacgactgcgcaaattcggctgattccaccgtcatgcccagccagaccacggtgcaggcagcaaaggagaagagcagcaaggggcgacgaccccacgcggtcgaccaggaaggcgcccagaatggcccaggcgaactgctggcagttgttgatgagcgtgatgttggcctgcgcaatggtgccccgtgtagccggccgtatcgaggacggagccgaggaagtaggaaagaaccgcattgccagcccactggccaaaaatggtgatggtgacgttgcacaacagacggtagacggcggcgcgcgagcggaagacgcccggtaatccaccagcgcttatcg

SEQ ID NO: 125 - DNA, 934 bp, Trichoderma reesei
cgagcggccgcccgggcaggtacaacactctctggctctcgggtgccatcatctcggccggtgccgctcgaggcggcctcaacgtcggaggcgactactcgtggcgactcatcacctggctccaggccctcttctccggcctcatcatcatcttctgcatgttcctgcccgagtccccccgctggctctacgtgcaccacaagaaggacgccgccaaggctgcgctcaccaagtatcatggcaacggaaaccccgactccgtctgggtccagctccagctcttcgagtatgagcagctcctcaacatggacggcgccgataagcgctggtgggattaccgggcgctcttccgctcgcgcgccgccgtctaccgtctgttgtgcaacgtcaccatcaccatttttggccagtgggctggcaatgcggttctttcctacttcctcggctccgtcctcgatacggccggctacacgggcaccattgcgcaggccaacatcacgctcatcaacaactgccagcagttcgcctgggccattctgggcgccttcctggtcgaccgcgttggtcgtcgccccttgctgctcttctcctttgctgcctgcaccgtggtctggctgggcatgacggttgcctcatccgaatttgcgcagtcgttcatcggaaatgacgccaacggcgatcccatctacagcaaccccagcgcttccaaggctgccctggccatgatcttcatctttggtgccgtctactctgtgggcatcactcctctgcaggccctgtatcccgtcgaggtgctctcctttgagatgcgcgccaagggcatggccttttccagctttgccaccaacgctgctggactcctgaaccagtttgcatggcccgtgtccatggacaagattggctggaagacgtacctgcccgggcggccgctcga

SEQ ID NO: 126 - DNA, 169 bp, Trichoderma reesei
gcgtggtcgcggccgaggtaccaataaacttcatacagtaaaaactcatgcaagagaaagaaaagaaaaaaaccggtctatatgagaatccgaaccactccaacaagataaaacaccacgcttgacgattcccccaaacaccgtatgtacctgcccgggcggccgctcg

SEQ ID NO: 127 - DNA, 189 bp, Trichoderma reesei
cgagcggccgcccgggcaggtaccctccactgtcaccaaagagactcgcatcgtagaatggagcagggcaaaggttgatgcctgtgatgttggccatggtgggaaagggatgttccgcaaaggtagccttggaaagatagagggtgtcgtcgagaaataagtatccctccacctcggccgcgaccacgc

SEQ ID NO: 128 - DNA, 307 bp, Trichoderma reesei
gcgtgtcgcgccgaggtactgctcagccatggacattgcgtcctcgatggctttctgcgcacggtctgtgaaatccattcgtgaagtcatggtgaaggttgtgtgtgatgtagatgtaggtgtaggtagtaaggtaggttcggtaaggtagggggaaaaggtaggtaggtaggtatgttgatcacaaccagtgcgtcaagatatgtcgtgtgtgttgttgttattcgttgtatggcaaacaagccagcaacgttgttgcaaagctagtcttggatatgttctttttacctgcccgggcggccgctcg

SEQ ID NO: 129 - DNA, 388 bp, Trichoderma reesei
gcgtggtcgcggccgaggtacatctgcctgtggttgagcgcctcacgatgcgcgaatgcgctgctgctggcagtcatgctgggcaaccttgacgaagagcggttccgtataaggagaaagatttcggtcaaagcagatgcctgttgcccgaggagggtcgaagcttggttctttaaccaccagcgcgagcagtgattgagaatgccgacacaatgagaaagataagaacgaaagaaataagagaggaagtcgtgaatcgtgacaagcccgaggctgaggcttgctgtgaaagagggcagacagcaggtgagtgtgacaacttccaccgagcaccaaagggggtttgtatatgcccttcgacggcgacctgcccgggcggccgctccga

SEQ ID NO: 130 - DNA, 464 bp, Trichoderma reesei
gcgtggtcgcggccgaggtaaaggccgagcggagatgataatgcgaaaaaaaacaggctgataacctagggcagcagcccatgcatgcatgcatgtatcaccatgcgcatcttgtgccgcctccttcgaccaaccaacaggcggcaaacagcaccttgtccaaaccccttctttccagaagagaccgatgggtatcaatccgtccgccgcctttccaatctgctcttgtatcgagaagattataaaccaatagccttgccttgcaacaaagcccatgttcttcctcccagacgccaagtagagatcagatccgaaagtcgaaaacgggggttgttctgaaaagagagaggaaaagaaagaaaagaaaaagaccttccggctgcttctcgcacctactctcacctccgctcgtggattcttaagacgctttttttcttctccacctgcccgggcggccgtcgaaa

SEQ ID NO: 131 - DNA, 367 bp, Trichoderma reesei
tgagcggccgcccgggcaggtacccaggtccggctaggtaggcagctcaagggggaaaacgggaactgaaacggaacagggaccaggcccaggagaagcgaaaacagaagacaaaggaacaaaaaaaagagacaggcacacacaccaccctagccctaaagagggacagacgcgggatcccgaccgagaaaattagaggccgctgcttgtttttatgcttgttcttggctgcagcagcacacaactcgacgatccgtgcattttctggtctgtggggaaggcgaactgagctcgactgcggacaaggccgttcaggcagggcgaggcaaggccggggaacagcgagtacctcggccgcgaccacgct

SEQ ID NO: 132 - DNA, 619 bp, Trichoderma reesei
gcgtggtcgcggccgaggtacactcaaatgctaaatcggacaacccctggcataggggaaagaaacgccttttgttccccccactgctggaaaaacaagtgctggaaaaaacagaaaagagtaaacaaaggggaaatacccagcaacgctgaagggggaataacacaaagatcctggccatatttacaccgactttgacattttttgttgttccaacacacatttagccaacaacggtagtggacgtattcctcagttagtccgacgccttcgagtccagccgcgtgagaatatccaaaagcacggaaaagtcgctcctggctcgcgtagccaagggtgaatcctggttgcgatggatgatggccagcaaactagctccgataaggcgaatcttttcaacgtttggctcgccattggcctgcaggccccaaaagggcgcctcgttcatcaccctcagcatgtctcgcacaatctccgactttctgagatcagcctgctcaacgccaggagcaaaataagagaggtcttcgaatttctgcgtaattaccatgcgcagacagtgaaacgtcacctgcaggttgatgcactgtatcacgtacctgcccgggcggccgctcga

SEQ ID NO: 133 - DNA, 581 bp, Trichoderma reesei
ttcgagcggccgcccgggcaggtacactcaaatgctaaatcggacaacccctggcataggggaaagaaacgccttttgttccccccactgctggaaaaacaagtgctggaaaaaacagaaaagagtaaacaaaggggaaatacccagcaacgctgaagggggaataacacaaagatcctggccatatttacaccgactttgacattttttgttgttccaacacacatttagccaacaacggtagtggacgtattcctcagttagtccgacgccttcgagtccagccgcgtgagaatatccaaaagcacggaaaagtcgctcctggctcgcgtagccaagggtgaatcctggttgcgatggatgatggccagcaaactagctccgataaggcgaatcttttcaacgtttggctcgccattggcctgcaggccccaaaagggcgcctcgttcatcaccctcagcatgtctcgcacaatctccgactttctgagatcagcctgctcaacgccaggagcaaaataagagagtcttcgaatttctgcgtattaccatgcgcagacagtgaacgtcacctgcaggtg

SEQ ID NO: 134 - DNA, 223 bp, Trichoderma reesei
gcgtggtcgcggccgaggtacaaaaccatcaatggcgacaacgacgaggatcattacacctacctcaagttgatgaatgtcggcaagcaagtcatcatcaaccgcatccaggactatcttcaaagccgcatcgtctactatctcatgaatttacacgtccggcccaggtccgtctggctatcaaggcacggtgaatctttgtacctgcccgggcggccgctcg

SEQ ID NO: 135 - DNA, 473 bp, Trichoderma reesei
gcgtggtcgcggccgaggtacacttgtcggcgtcagtgcacagatttggcagcaactcctcggtggtaatgtgatgctttactaccttgtctacatcttcaacatggctggcatgtccggaaataccgcgctcacgtcttcaattatccaatatgtcatctttctcgtcacgactggaggagttctctttgtcgttgatcgcattggtcgccggtggttgcttattgttggggccatcatttgcggcgtcatccatttcatcgtccgtgccgtcatggcagtctacgggcaccacgtcgacagtgtggatggaaacgatattctgaggtggcagattggtggccctcctgccaaggccatcattgcgctttgttacatctttgttggagtctatggagtcacatgggcccccggtgcatggatttactgcggagaagtcttccccttgaagtacctgcccggcggccgctcga

SEQ ID NO: 136 - DNA, 321 bp, Trichoderma reesei
gcgtggtcgcggccgaggtgggagagggaggcggccaagtctgggaagaagaagatttgagggggttaacagaagatttgagggggttcggtcggatctatatctgattgccggttgggcattgggggtcaagttttgtctgatgggcgtggggagaggcgagatgcgagattggccgggtaagctatggcgttttgtgctatggggagggtgatgaaaggggggagaggataacaatagtctttcaacagactcggatgcagtttgttggaaggatgaggaaaggaagtcgaaaaggtacctgcccgggcggccgctcga

SEQ ID NO: 137 - DNA, 486 bp, Trichoderma reesei
gcggccgcccgggcaggtacgtgaaagggagaatctcacagagaaaggctgagcaggcgaggaatgaagcaaaggcagtttcaacacatactgatggatctcccgacgacttcttggagaaactgatgatcaaaaataaagatgctccatccaaggtgactgattatcatgtcttcatgatgagcatgtccaacatcatcgcgggatccgacacaacggccattagtctatcggccatcttatactatctcatcaaacatccgcacgtcatgagcaaagtcagagaggaagtcgacctcatttctgatgttggcgctcacctgagcttcaaagagagcctcgaaatgccatactggcaagctgttatgaaggaagcactacgtctacatcccgccaccggacttcccctatggagaaccgccaccaagggcggcatagaactgaatgggcagttctttcccgaaggtacctcggccgcgaccacgc

SEQ ID NO: 138 - DNA, 531 bp, Trichoderma reesei
tcgagcggccgcccgggcaggtacattatctttaccatctgggatctcgtccagacggttgtcgtctactttttcattcccgagaccaagggacgcactttggaagagcttgacgaaatcttcgaggccaagaacccggtcaagacgtcgacgacgaagaaggccgtggccgtggacagccacggcgacattgtcaatatcgagaaggcttaatgccacggacttttacttgcggtcacgatactataccactatatcaagaatatctgggcagttgtgcgcagggcttggggctgtgagctgatgttttgtttcgatggttccttgtcagggcagaggaaacaactttggttgctatttttagctgttacttttgtttccgctgataattgtgaaatatgagggtgaggggagagccaagaggagagccctaaggatgcagcatgaatctgcaactgccacacagcctgctattctcgaaaaaaaaaaaaaaaaaaaaaaaaaaaagcttgacctcggccgcgaccacgc

SEQ ID NO: 139 - DNA, 489 bp, Trichoderma reesei
gcggccgcccgggcaggtacaagcttttttttttttttttttttttggtgctgcatccttagggctctcctcttggctctcccctccccctcatatttcacaattatcagcggaaacaaaagtaacagctaaaaatagcaaccaaagttgtttcctctgccctgacaaggaaccatcgaaacaaaacatcaactcacagccccaagccctgcgcacaactgcccagatattcttgatatagtggtatagtatcgtgaccgcaagtaaaagtccgtggcattaagccttctcgatattgacaatgtcgccgtggctgtccacggccacggccttcttcgtcgtcgacgtcttgaccgggttcttggcctcgaagatttcgtcaagctcttccaaagtgcgtcccttggtctcgggaatgaaaaagtagacgacaaccgtctggacgagatcccagatggtaaagataatgtacctcggccgcgaccacgc

SEQ ID NO: 140 - DNA, 557 bp, Trichoderma reesei
gcgtggtcgcggccgaggtacattatctttaccatctgggatctcgtccagacggttgtcgtctactttttcattcccgagaccaagggacgcactttggaagagcttgacgaaatcttcgaggccaagaacccggtcaagacgtcgacgacgaagaaggccgtggccgtggacagccacggcgacattgtcaatatcgagaaggcttaatgccacggacttttacttgcggtcacgatactataccactatatcaagaatatctgggcagttgtgcgcagggcttggggctgtgagctgatgttttgtttcgatggttccttgtcagggcagaggaaacaactttggttgctatttttagctgttacttttgtttccgctgataattgtgaaatatgagggtgaggggagagccaagaggagagccctaaggatgcagcatgaatctgcaactgccacacagcctgctattctcaatggatgcgtgcctcttttaaaaaaaaaaaaaaaaaaaaaaaaaaaaaaaaaagcttgtacctgcccgggcggccgctcga

SEQ ID NO: 141 - DNA, 230 bp, Trichoderma reesei
ttgatatagtggtatagtatcgtgaccgcaagtaaaagtccgtggcattaagccttctcgatattgacaatgtcgccgtggctgtccacggccacggccttcttcgtcgtcgacgtcttgaccgggttcttggcctcgaagatttcgtcaagctcttccaaagtgcgtcccttggtctcgggaatgaaaaagtaggggacaaccgtctggacacctgcccgggcggccgc

SEQ ID NO: 142 - DNA, 305 bp, Trichoderma reesei
tcgagcggccgcccgggcaggtcacggacttttacttgcggtcacgatactataccactatatcaagaatatctgggcagttgtgcgcagggcttggggctgtgagctgatgttttgtttcgatggttccttgtcagggcagaggaaacaactttggttgctatttttagctgttacttttgtttccgctgataattgtgaaatatgagggtgaggggagagccaagaggagagccctaaggatgcagcatgaatctgcaactgccacacagcctgctattctcaatggatgcgtgcctctttcc

SEQ ID NO: 143 - DNA, 339 bp, Trichoderma reesei
tcgagcggccgcccgggcaggtcggcgctggcggcgctcctcaccagggtggcgatgacggccctaccgtcgaggaggtcgactaaatgcacaacaagcccttttgataccccaaacatcatcagacttgagcctcaagcttggtaacgcgtctacgatgtgtggaggcctactctaggggatcaaggcatgatgcatgattaaattctttcctttgttctcatttgctttttccgcactagcatttcacggatatgaagggtaaaaaagctgggcgggttggccctggttttgtacctcggccgcgaccacgctaagggcgaattccagcacactggc

SEQ ID NO: 144 - DNA, 265 bp, Trichoderma reesei
gcgtggtcgcggccgaggtacaaaaccagggccaacccgcccagcttttttacccttcatatccgtgaaatgctagtgcggaaaaagcaaatgagaacaaaggaaagaatttaatcatgcatcatgccttgatcccctagagtaggcctccacacatcgtagacgcgttaccaagcttgaggctcaagtctgatgatgtttggggtatcaaaagggcttgttgtgcatttagtcgacctcctcgacctgcccgggcggccgctcg

SEQ ID NO: 145 - DNA, 554 bp, Trichoderma reesei
agagcgttacttggatcccgatctccgtcgtcctcctcgccagcagtctcatcggctcttcattgtgggaagaatcatccagttcaaccggttgaggcctttcaaaggccccttcttgactcatttcaccaatctgccgcacaggaaggctctttcaaggagagatgccacgagtggtatgcggaggtttgtgaaacatacggcccgatagcaagagttgcaccaaacctcctgattacgtccgacccggatgtgtggattcatgtaaacaacaagcccggatacaagcgctccgattggtattacactgcctgccgcctcgagtatgggcgtgacaatgtcttttcgcagacggacaacaagaagcatgagcagaggaggaagcagatggctccagggtattccggaagagaaaacctcgacttggaaatcgccatcgatcagtgtgtccaggaattcctcgacttgatcagatccaagtatgtctccacagacgccaagatcgtgcccgtggacatggccaagaaggtccagtacctcggccgcgaccacgc

SEQ ID NO: 146 - DNA, 274 bp, Trichoderma reesei
gaaggcaccaatgacaccggcgaggatctccttggcctgggcgtggtcgtcggggtggccgttctcggcaacgtggtcctcgtaggccttggcagcctcataagcggcagcacctccgatgagctcgtgagaccactgggcttcgtgaggtcgctcggtaacctgctggtaggcctgagcctgctcggagtcgtcgtcgaaccaacccattgtgaatatgaagagaagttgagtgttgtgtgtggtttgtgtgacctgcccgggcggccgctcg

SEQ ID NO: 147 - DNA, 338 bp, Trichoderma reesei
ccgaggtctttgggtgtctcggaccacatgggctattcgcagattggagctcacgcacactgcgcgttcccatcaaaccagcaatcgcaacttactgcctttgttcagaaattcttgctgggccagtccacaaatacggcgattttccaaagcgacttttcggccaatcaaagccaatggatcgactggacaaccccaacgctgagttgagtcttacggccagggaaacgcgcatatttggcgattggcggttcctgtattatgacttggtaacccaagccataccaagcttagcagagggtgttgaaaggaaaggtacctgcccgggcggccgctcg

SEQ ID NO: 148 - DNA, 246 bp, Trichoderma reesei
ggatatctgcagaattcgcccttagcgtggtcgcggccgaggtactggttgctgagctgtgcctcggcctgctcctgtgcatggcgcttggccctctcacgatcgatgaagtcaaggcccttggtctcaacctcgcggtcgacgaaggcaccaatgacaccggcgaggatctccttggccttggcgtggtcgtcggggtggccgttctcggcaacgtggtcctcgacctgcccgggcggccgctcg

SEQ ID NO: 149 - DNA, 927 bp, Trichoderma reesei
cgagcggccgcccgggcaggtacggacagaaagagccggtgcagaggaagaaggttggctgcttgattaccagtctttaaaaagcttggacggcctccggtttgtcataccgaccctttgagcccgcgattctccgcacctgatttcgttattgcggcgacctcactgatcattataatggatctcgttccccatggctgcttcagcttggtctcttccggtcgcacttggggacttcacctctcaaatagccaacgatggcatctcgaaaaatcatagacagtcgccaattcgggctttccatgctccacgactacgatagcccttggcaccgcttcaccacaggagggacactgatacttccagccgattttcatgaacccatgtcctcccaagcatacctcgtgtccactctgatattcgtttgtttcaaaacaagacaagacagaagtgtttcctattctttccggaattggccatatattgccccgacagatatccagcccgtatgcgaaatcatccttccaaccagaaatcccaagtcaacagatgagacccgtcttcaagaacggacgtggggtagaaaaaccctccctttgctttacgacaactcataacgccgcgtgacaagattttcatgcaatgaatgagccaaaaatccgacaacggaaacctggaaccgaaagaaaagagaaaattggaagactagaaccggagaagcggtaaaaggtaagaaaaattcaaggaagaacaagacggccatccaacaagcacttctatgcacaagaatggtcgtcagccttggcatcaaccataatttcgttgcgagttgttcaggcgctggcgcttctccggcgggctatcgtgatcggataaacggcccgaggaagcatccatcgtcgagtacctgcccgggcggccgctcga

SEQ ID NO: 150 - DNA, 504 bp, Trichoderma reesei
gcggccgcccgggcaggtacttttcttgtccaatccgatccaagtagcgtcggcaaaatggaatcgtgtggaaattcttcttgatcacgttcaagagtgatttggcagaagacaagcgcaagtccaccttgggcgcatctgcgcgcagggcatagtgcgagacatcgccctgatcgtaaacccaaccgttgccagtgcttccaaaggtctcaatggcaaagatgtcaccctcttccattttggtcatgtcgtctgacttgacagctgggatgcttttcgtgccgtggatgcgatacggcaaaattgtatggccgcctatgttgcgaatcgacttgattggatatgtcgcaccgttgatctcgcattcataactctccatggcctcttgaatgtatccacccagttccccgaggcgaacatcaattccagcctcacgaacgccagtatttgtagcatctttgacggctgcgaggaggttgtcgtacctgcccgggcggccgctcg

SEQ ID NO: 151 - DNA, 235 bp, Trichoderma reesei
gccgaggtacgtctccaccgctgcacgttgatagcaactccaccaatcctccgcagatgacgatatacagtggctacaccggtattgactgaaacggtcttttcaaaaactgaataaccctctccgccagccattgtctcgcctcttcctccaagacagtatgccccgtcccgggtatgatgccagacaatggactgacgtgcgtgttcaacgtcttgtacctgcccggcggccc

SEQ ID NO: 152 - DNA, 510 bp, Trichoderma reesei
cgagcggccgcccgggcaggtacaacactgatctcgtgcttacgattgctatcacggagccaacctctgaacaatacacgatttacgccgacggtaaggaaatcggcaggtacaatttaaatcccttaacgaggaacaattggagggcaagtctggtgccagcagccgcggtaattccagctccaatagcgtatattaaagttgttgtggttaaaaagctcgtagttgaaccttgggcctggctggccggtccgcctcaccgcgtgcactggtccggccgggcctttccctctgcggaaccccatgcccttcactgggtgtggcggggaaacaggacttttactttgaaaaattagagtgctcaaggcaggcctatgctcgaatacattagcatggaataatagaataggacgtgtggtctattttgttggttctaggaccccgtaatgattaatagggacagtcggggcatcagtattcaattgtcagagggaaattcttggattattg

SEQ ID NO: 153 - DNA, 351 bp, Trichoderma reesei
cgagcggccgcccgggcaggtatgcccttcactgggtgtggcggggaaacaggacttttactttgaaaaaattagagtgctcaaggcaggcctatgctcgaatacattagcatggaataatagaataggacgtgtggttctattttgttggtttctaggaccgccgtaatgattaatagggacagtcgggggcatcagtattcaattgtcagaggtgaaattcttggatttattgaagactaactactgcgaaagcatttgccaaggatgttttcattaatcaggaacgaaagttagaccatctccgagtctgacggcttcaagagagccgtacctcggccgcgaccacgc

SEQ ID NO: 154 - DNA, 180 bp, Trichoderma reesei
gcggccgcccgggcaggtgcaagcccgcggccggagtcgatgggaatctgaacaaaaagaaagatgcagatgcttcctcctcaacacggttctgcagaggacggagagggagcgttggtttatgaaggtggaaatcgcgggaagacggtgatatggaggagacctcggccgcgaccacgc

SEQ ID NO: 155 - DNA, 298 bp, Trichoderma reesei
gcggccgccccgggcaggtgggaaaccttgtgaacacgctcaattcttcaattacgccgcttcctttcccttcatgtaaacctccctacagacgattgtgtgattcagcccactggacgtgtcacctaccttagccggtgtaggagaattttacctctcagagtcctcaggtctgcaacaggacctttgacctcacaatgccgttcaagcagcacaatcgccagtatgacttggtcgtctttggagccactggttacaccggccgaatggcagacgagtacctcggccgcgaccacgc

SEQ ID NO: 156 - DNA, 420 bp, Trichoderma reesei
tcgagcggccgcccgggcaggtacttggccttgaaccaggggttctgcagcaggttgttgatgagcgagccgtcgtagccgttcatggtgctgcagaagaaggcaatgatggagaagctgtagacgaggacctgagccttggtccaggccttgggcggctccctcatcatggcctcctcaaaggcctcgtgtccggtcacgaccttggtcctgatctctccatggtcgagctcctcgtgagcgtgaatgtcttctttctcgcccattgttacgggtaatctctagcctctgggccagagacagcgctccagtcggggaggcagcgttgaaggaaagcaattgctgcacaaaacgccccctttcttctgaggtgaaggagagtcaagggaactggcgagttgacctcggccgcgaccacgc

SEQ ID NO: 157 - DNA, 419 bp, Trichoderma reesei
gcgtggtcgcggccgaggtacttggccttgaaccagggttctgcagcaggttgttgatgagcgagccgtcgtagccgttcatggtgctgcagaagaaggcaatgatggagaagctgtagacgaggacctgagccttggtccaggccttgggcggctccttcatcatggcctcctcaaaggcctcgtgtccggtcacgaccttggtcctgatctctccatggtcgagctcctcgtgagcgtgaatgtcttctttctcgcccattgttacgggtaatctctagcctctgggccagagacagcgcttcagtcggggaggcagcgttgaaggaaagcaattgctgcacaaaacgccccctttcttctgaggtgaaggagagtcaagggaactggcgagttgacctgcccgggcggccgctcga

SEQ ID NO: 158 - DNA, 277 bp, Trichoderma reesei
gcgtggtcgcggccgaggtacttgggccctggtgcctccccctactctgcggtcgagtgggagcttgccatctccaatggaagcatcgtgataccgcggttgttggagaacaaggtggtcaaccaccaggttcaggacactacctcaaagtatcacccgcgcgaggaaacttataccgatcttagccgttctctgggtctccgaatcaattctgtcggagtcttggactctctgtacctgcccgggcggccgctcgaaagggcgaattctgcagata

SEQ ID NO: 159 - DNA, 456 bp, Trichoderma reesei
gcgtggtcgcggccgaggtaccagccgctcctgcgccgacaaccgaatccatcgtaatagtagccgtatccgcagatgctatctcgagcgaagaggtccattactggcgccatgcctgctggataaataaagggaggatgccagagagagagagagagagagagagagagagagagagaaaggtaagagttgcgtcgccgacctcgacaggtcgatggaatcagcaatagagaacccaagtgtcgtcgtcacttgttgtgaatgtaggtccggtcgctttgctgtggggatcgcctttcaatgattgtttgcgatgcacagcgatgcgcgatagtaggtagattgaaagagtggaagaaaaggggggagaaagatgaagagtaaaaggaagaagtgaggaggtggtgcgtgtgtgtgtgtgtgtgtgttaggtttgacctgccccggcggccgctc

SEQ ID NO: 160 - DNA, 336 bp, Trichoderma reesei
gcgtggtcgcggccgaggtaccatctcgtagataggtatgcaatgctcagtccgatgagccacgagaagacgaagaagagcagaggccactttgagagtaggtatagatatccttctcgggtctcgtcctttgttcgagttcccagcaggccctccaccgcgcctctgcctttcttcttcttggcccctcgcttgctgcggtatttgcccgggtttacgggcgcccagtcgttttgcgctgtgacaaacgtccccatgctcggcgttggaggcacaggcaggtctcctccggcagcaccggccgctgctgcgacggcggcgacatcttcttccagg

SEQ ID NO: 161 - DNA, 401 bp, Trichoderma reesei
gcgtggtcgcggccgaagtcttggttcatcatcctcttcttctcttctctctcgtccttccccaagcataaagcggtgcgacgcaaccctggggattcttacgcctctgacacaacattcctcctcacccccgtcaccgaatcacaaacaacaccacaagccactcactcaccagtcagcgtggcacgactcctccgccctctttggtgattatacgtcaaccatcacagatccggcggacttgttgttgtttgtatagaagcaacgacgagacgacaaaaccgtcatcagagaagccgcgaacacaatacaacaccaaaacaacacacatacacagacatacacaatggccgctcagctcatcatgcctaccgcaccgggtacctcggccgcgaccacgc

SEQ ID NO: 162 - DNA, 398 bp, Trichoderma reesei
cgatgtcttcttctcgtctataaacaacaaaaccccaccagtctctggatgttcattggcgcgaacccctggagtgccgcctttgtatgctcaaggttccctccggatgaaaagtggttatgctgtccaccaaaagccaccacatgtgtattaccgccggcgttgttccgtctccgaagccatagagaagcccgttgtgtggatagctgatacccgtaaaagagcggaggtccttgtcactgatctcggcatggaccttgacacactgattcacgtggccggtggtggctgctgctttccgtcctggtccagaggcggatcgaaggcaacatcgttcaggacgttgagtgggatggcgcaaatcatcttggcggctttgtacctcggcccgaccacgc

SEQ ID NO: 163 - DNA, 317 bp, Trichoderma reesei
cgagcggccgcccgggcaggtctcagcaaggaggtctcgtttgtcgggtaggtggagtccagccacagcatgttggcgtagtaatcatcccacagactcatgaccagaaccatgccgccagaggtagccttcttgaactgagtcaggccgcccttgtctgagaaagaggatccgccgaattctgcctcctcagctgtgcagtaatcatcgttgagctcgttgccagagtaactaccaagctcggcgttgggctgctggaaagtgacgccattctggacatagtatcggttgatggcacacctcggccgcgaccacgc

SEQ ID NO: 164 - DNA, 874 bp, Trichoderma reesei
gcagggacaccggagctggtggagcagcttccgcgcacggcaccgggtgtggaggaggtctcgtttgtcgggtaggtggagtccagccacagcatgttggcgtagtaatcatcccacagactcatgaccagaaccatgccgccagaggtagccttcttgaactgagtcaggccgcccttgtctgagaaagaggatccgccgaattctgcctcctcagctgtgcagtaatcatcgttgagctcgttgccagagtaactaccaagctcggcgttgggctgctggaaagtgacgccattctggacatagtatcggttgatggcacccgacgtctcgaactgggtgacaacggtcaatttcttggtggtatcgagggtaaagcttgagccagggccgtagaagctggtgttgcccaggcggtatgggttccagtcgcagccatcgggatcgcaagtgccgccatatctgttatcggagtaagttccgccgcacccatcaccctcgcagatctcctggccgacagtcgtgcaagggtggggggtaagagcctcggagatggagttggcctcccagatatccatctcagagcagcagcttccgtgtcctccaatgcccgtgttcgcgttgttggatgacggctcccagccctcaacgttggcctggccattgatgaacttcagatcgcggggacactggctgtcacagtacctgccatccgacaggtaagcggaaaatagtcatcccgtcgtcgttgacgaagtgctgcatctggccgatgccatcggggtagttgtttgagccggtgaagttcttcaacggaggataaaccttcgaggtaacgcaagtgccatctgtggtacctcggccgcgaccacgc

SEQ ID NO: 165 - DNA, 373 bp, Trichoderma reesei
gcgtggtcgcggccgaggtacacacccttcgacgtcgacatggtgccgatatgagatgtcgaccacgtcatttcataaaccatcatctcatatgaacgcaagggaaacgaaagcagaagtcgcgtttgggtatattgcccccatatttctccctcgcaggaggagggttccttctcacatacgccatgagccgtcctttataaggcaagagtggcattgcgacacattcccataatgtgcatacattcactttcaccagtttacatactcaccttcctttcacgtcacatatttctgcacaccttcgttcatatccctttcttgtgcatctcattcaggagtctttttctgggtacctcggccgcgaccacgc

SEQ ID NO: 166 - DNA, 486 bp, Trichoderma reesei
gcgtggtcgcggccgaggtactactgctagtctttacaaagataggatggcaaagttgagcactctccggcttgcgagccttctttcccttgtcagtgtgcaggtatctgcctctgtccatctattggagagtctggagaagctgcctcatggatggaaagcagctgaaaccccgagcccttcgtctcaaatcgtcttgcaggttgctctgacgcagcagaacattgaccagcttgaatcgaggctcgcagctgtatccacacccacttctagcacctacggcaaatacttggatgtagacgagatcaacagcatcttcgctccaagtgatgctagcagttctgccgtcgagtcttggcttcagtcccacggagtgacgagttacaccaagcaaggcagcagcatttggtttcaaacaaacatctccactgcaaatgcgatgctcagcaccaatttccacacgtacctgcccgggcggccgcttcg

SEQ ID NO: 167 - DNA, 365 bp, Trichoderma reesei
tcgagcggccgcccgggcaggtacaagcttttttttttttttttttttttttttgtcggtagttatatatccaattgctacctatgtatacctcatgtatccagaactcgcaagcataagagctcagccatctactactctatcgatccacgaggggcagacaccgtatgtatgtcgtcacaatcatgctggaaactcgagcctgtgaacgcttcctgcaagatcgcaactcatgtccacactactctgcgttacctcctactgtcgagcttgtccatgtgcgctcctctatccctgagatgctgtcgtccgatcatgcttcatttttaccctccttggcgtgttcacctcggctgcgaccacgc

SEQ ID NO: 168 - DNA, 321 bp, Trichoderma reesei
tcgagcggccgcccgggcaggtaccagcttggtcacgagccatgttaagagccatggagaccttgttctcaaaggtcgctcggacgttcataccaggcaaggcttccaactcgttgtttgtagccatggccgtaagcctggcgacctcggccttttgggtgtcaatgtgcacctggaccttctcaatcgtctgcttatccggaatggtatcaccgataccaatgctgtggccgttctgcagcagccagtaggtaaccacttgctgaaccccgttaaggaacgccatggcaccttctgggcccacctcggccgcgaccacgc

SEQ ID NO: 169 - DNA, 385 bp, Trichoderma reesei
tcgagcggccgcccgggcaggtacagcgagagctacgcttcgctggtcaagcttgtgcagaaggaggctggcaagcaggcgttttggacaaagggtgaatcgaaggcgtgaaagaagaaaaaagggggaaaaggccaagttgtgggatttgaccagtgttgggaggttcgacatgtttgggtgaatgggggtggtggtgtgatgcaaagtaatctgggtgtatattaaccataccagagggattgtcttgcagcaagactgctggggcaacggcggcgttcgggtatataaagtacctcggccgcgaccacgctaagggcgaattccagcacactggcggccgttactagtggatccgagctcggtaccaagcttgatgcatagc

SEQ ID NO: 170 - DNA, 359 bp, Trichoderma reesei
ccgccgcctaaattcaaattcggcattggcgtcaggcccctttgtcattaccattgccatcggcttcggccgctcatcacccttcttcagtctcccttcgtaattgatgaggaagaatgcaagaaaaagcttgatttcgttcccggcaaagaaccgaccagggcacgcgtgcttgccggctccaaagttgagatttgtgtcacaaagggatgtaaactgccagcgattgctcgcctcggccgactgttgcctcatgttgtagaatcgcagggcatcgaactcttcggggctttgataaaattgttcgtcgacagaaataccggcctggggagcgagtacctgcccgggcggccgctcga

SEQ ID NO: 171 - DNA, 402 bp, Trichoderma reesei
tcaagctctactgctccgtcctccataaaggcagtaaagccaaaggccaaaagcataccctctttctgttcatacaccctgaatcagttcgagagatcacgttgaatgatggacggtcctcggggccgagcacgtctaagcccagccgcccgatgttatcattctctttgacacaacatccttccctcgttgtccccaagggtcttgttttggagacgaaagaacagagcaaaggcgcattaagtgtaatgctggctttgactagagcgactgaattcaccatccaccttaacaattccaacctttcttcaccgctgaaaagatcgcgcttggatttgattgcccgcagattctcgctggaatctgattctcatcgtccccgtacctcggccgcgaccacgc

SEQ ID NO: 172 - DNA, 237 bp, Trichoderma reesei
gcgtggtcgcggccgaggtactggcactacacctttgaggactccatggacctcattgccaagctgcccaacattgcctcgcgcatctaccagaacgtcttcaagggcggaaaggtggcccccatccagaaggacaaggactactccttcaacttcgccaaccagctcggcttcggcgacaacgccgactttgttgagctcctgcgtctgtacctgcccgggcggccgcttaaggcg

SEQ ID NO: 173 - DNA, 431 bp, Trichoderma reesei
tcgagcggccgcccgggcaggtactggtccgtccgccgcaaccaccgctcgagcggctccgtcaacacggcgaaccacttcaacgcgtgggctcagcaaggcctgacgctcgggacgatggattaccagattgttgccgtggagggttactttagctctggctctgcttccatcaccgtcagctaaagggggctcttcttttgtgatgtgtgaaaaaaaaaaaaaaaggatggtggataaaagggggttgaagggcttgtgttctttggctctgtagaggctctagggggttggattgggctgactatggtctcccctttgtatgctacacactgatcagacgatcgtagtcagttgagagatgagcttcattggtcgatatgaaaaaaaaaaaaaaaaaaaaaaagcttgtacctcggccgcgaccacgc

SEQ ID NO: 174 - DNA, 351 bp, Trichoderma reesei
tcgagcggccgcccgggcaggtcctgacgctcgggacgatggattaccagattgttgccgtggagggttactttagctctggctctgcttccatcaccgtcagctaaagggggctcttcttttgtgatgtgtgaaaaaaaaaaaggatggtggataaaagggggttgaagggcttgtgttctttggctctgtagaggctctagggggttggattgggctgactatggtctcccctttgtatgctacacactgatcagacgatcgtagtcagttgagagatgagcttcattggtcgataaaaaaaaaaaaaaaaaaaaaaaaaaaaaaattgtacctcggccgcgaccacgc

SEQ ID NO: 175 - DNA, 345 bp, Trichoderma reesei
tacacgcccgaacacaggcttttcacacgctcgacggaagcttccgctaagacagcacgagacgatgctctactcctgaagagccagacatgtcttttattcttcttactttcgtttatacaatttgggtctaactctgaccgttgatgcatgggcgccttggattctatatttgagggggaaaactggcgcaaggcgttccatgctgacatgcatgcaatatggcggttaatgatgcaagggccctggcggccgtgatgaggcagacttacagagagtgcccgaaaccccgtcttttttcttttttcttatctcctttgtcgtgtacctcggccgcgaccacgc

SEQ ID NO: 176 - DNA, 370 bp, Trichoderma reesei
tcgagcggccgcccgggcaggtcccacatccaggtgccggaatattgaccgggtcccctttcgccaaacggcgcgaagtgcgcctttgaaacggaacttccctatggcttaggatcgactaacccacgtccaaccgctgttcacatggaacctttccccacttcggtccttcaagttctcattgaagtatttgctactaccaccaagatctgcactagaggccgttcgacccgggctcacgccctaggcttcgtcacgacctccacgtccgcctactcctcggggcatcgtttctacccgagggcgaggtatgggtgagacgcttgagcgccatccattttcagggctagtacctcggccgcgaccacgc

SEQ ID NO: 177 - DNA, 223 bp, Trichoderma reesei
gcgtggtcgcggccgaggtttcaagttctcattgaagtatttgctactaccaccaagatctgcactagaggccgttcgacccgggctcacgccctaggcttcgtcacgacctccacgtccgcctactcctcggggcatcgtttctaccccgagggcgaggtatgggtgagacgcttgagcgccatccattttcagggctagtacctgcccgggcggccgctca

SEQ ID NO: 178 - DNA, 607 bp, Trichoderma reesei
gcgtggtcgcggccgaggttgggaatcttctctctactttctcctcgacatgaagtcatctatctctgttgttttggctcttctgggccatagcgctgcatggtcatacgccaccaagtctcaatacagggctaacatcaagatcaatgcccgccagacctatcagacgatgattggagggggttgttcgggcgcctttggtattgcttgtcagcaattcgggtcttctggtctgtcgcctgagaaccaacagaaggttacccagattctcttcgatgagaacattggcggcctgtctattgttcggaatgatatcggctccttgccaggaaccaccattttgccaacctgtcccgcgacgccgcaagacaagttcgactatgtgtgggatggcagtgacaactgccagtttaacctcaccaaaacagctctcaaatacaatccgaacctttacgtttacgcggatgcctggtccgctcccggctgcatgaagacggtcgggactgagaacctcggagggcaaatctgcggtgtgcgaggaaccgattgcaaacacgactggcgccaagcatatgccgattatctcgtacctcggccgcgaccacgc

SEQ ID NO: 179 - DNA, 441 bp, Trichoderma reesei
gcgtggtcgcggccgaggtacgagataatcggcatatgcttggcgccagtcgtgtttgcaatcggttcctcgcacaccgcagatttgccctccgaggttctcagtcccgaccgtcttcatgcagccgggagcggaccaggcatccgcgtaaacgtaaaggttcggattgtatttgagagctgttttggtgaggttaaactggcagttgtcactgccatcccacacatagtcgaacttgtcttgcggcgtcgcgggacaggttggcaaaatggtggttcctggcgaggagccgatatcattccgaacaatagacaggccgccaatgttctcatcgaagagaatctgggtaaccttctgttggttctcaggcgacagaccagaagaccagaattgctgacaagcaataccaaaggcgcccgacctgcccgggcggccgctcga

SEQ ID NO: 180 - DNA, 317 bp, Trichoderma reesei
ggaagaagtcaagctttgatggtgtgtaaaataggctgagatccttcaccaacagctgccagatattcatcgtcaatcggttgcggtattggaaccgtattgggctcgcccacaacgttccacccaaatgtgaacgatgatatcttatccatgatgaccaaaacatgccatactctgcgtctcatctcccgctccaactggcccatggactcaggagcatctttgtgaagcccaagcccatgggcaactctttgggcgattccaagtgtgctccagcaccgtgaggcaaaggatgtgtacctcggccgcgaccacgc

SEQ ID NO: 181 - DNA, 286 bp, Trichoderma reesei
tcgagcggccgcccgggcaggaatagccgttttcctgctgctgatcgcagacgttggggatgtgacccagagcccagttcatgacggcaatctgcacgatagcagaccagacagaggccagaagctgcgacgtgaacatgacgcgagggggcaccttcatgtaatggccgagcttcagatcctgggcaaaatacaaggcctgggacatggaaatgtagccatagttcttgaacatcatcatggccaggggccggccggggaccatgtacctcggccgcgaccacgc

SEQ ID NO: 182 - DNA, 317 bp, Trichoderma reesei
gcgtggtcgcggccgaggtacaagcttttttttttttttcttttgtttttcccaagcttgaattcgttaaatctcgtgttcgtgttttattcacaagcaccaatagctacattatccgaccaactgcccgctatgataaacgtgaagtcgtgctccaaccatgagcaggcgcactaccaaatatcgcttcacgaggctcctgttttcgccaccccgaagccaaatcatattttcgtgagacaagacaaggaaacaataggaaaggggcaagatagaaatcaacaacaaaacacatgtacctgcccgggcggccgctc

SEQ ID NO: 183 - DNA, 523 bp, Trichoderma reesei
aatccaaacgacgctggctggacgaggccagctatattcgggagatccaccgggtgtcaactttggctggggaggctacagcggagacgtcaacaccgtctggttcgacgacatctcgattgggtcgacccgcgtgggatgcggccccggcagccccggcggtcctggaagctcgacgactgggcgtagcagcacctcgggcccgacgagcacttcgaggccaagcaccaccattccgccaccgacttccaggacaacgaccgccacgggtccgactcagacacactatggccagtgcggagggattggttacagcgggcctacggtctgcgcgagcggcacgacctgccaggtcctgaacccatactactcccagtgcttataaggggatgagcatggagtgaagtgaagtgaagtggagagagttgaagtggcattgcgctgggctgggtagataaaagtcagcagctatgaatactctatgtgatgctcattggcgtgtacctgcccgggcggccgctcg

SEQ ID NO: 184 - DNA, 356 bp, Trichoderma reesei
ttcgagcggccgcccgggcaggtcccatactactccccttataagcactgggagtagtatgggtcaaggacctggcaggtcgtgccgctcgcgcagaccgtaggcccgctgtaaccaatccctccgcactggccatagtgtgtctgagtcggacccgtggcggtcgttgtcctggaagtcggtggcggaatggtggtgcttggcctcgaagtgcttatagggggatgagcatggagtgaagtgaagtgaagtggagagagttgaagtggcattgcgctgggctgggtagataaaagtcagcagctatgaatactctatgtgatgctcattggcgtgtacctcggccgcgaccacgc

SEQ ID NO: 185 - DNA, 268 bp, Trichoderma reesei
gcgtggtcgcggccgaggtaccgccgccgatgagggtgtcctgtccctgtggcgtggtaacactgccaacgccatccgatacttccctacccaggccctgaactttgctttccgtgacaagttcaagaagatgttcggcttcaagaaggaccgtgatggctacggcatgtggatgctcggtaacctggcctctggtggtgctgctggtgccacttctatgcttttcgtctactctctggattacgcccgtacctgcccgggcggccgc

SEQ ID NO: 186 - DNA, 722 bp, Trichoderma reesei
gtggaaattcagagtcgaggagggcgcaaggcttggtttggcaaagtcattgagcggcgacggtggatacgagcaaaagaaagggcagaggaagagaaacaaaaggggtgcaaagatgttcaaccaagaagccaaagcgggtggatcccgcaccccctggtttttacaatcggatccatggagtttcatgatcatgacttggggatgttccagaggaagaacttccagaagatgtgctgcagaatcctgcatgggtcaaggcgtgtgcctggcatcgagagaatgaggcaaagagggtcttgggagcccgtgcagccaaggaagcgcacagagaagcctggaactatgctgaaagcatcatgagagatgccacccaactggcatctgaaagcagcggatgatcatcgaggcaaggacgacgacacatgcatttatgcctctttttcttcctgatatacatactgatctttcttgttatcctgattttttttcgcctcaagatactcctggtgcgttgatttatgtggaaagggggcggacatgggcggcagaaaggctacgttggttggcgtcacggaattatgaggttatcacagtgggacgtataacattttccacctttttctactttctgtaacagacgcagacgttgatcggcgtcgggcgagattgcccagcattttatatctttgaaatgtcatgtacctcggccgcgaccacgc

SEQ ID NO: 187 - DNA, 189 bp, Trichoderma reesei
gcgtggtcgcggccgaggtacaagtcatcctacttctacttgcttacgggccttttcttcccaaggttcctacatttgctgcagcacggatttggcatctcagcatgggagggacgaaacgaaatggcctagcctgcagaacttcaagggcgtgcggacgggtctgtacctgcccgggcggtcgctcga

SEQ ID NO: 188 - DNA, 300 bp, Trichoderma reesei
gcgtggtcgcggccgaggtacggatgcctggtgatggaggtggaggactggatcgacggcatcaacaacccggaatgggggcggaagcaggtctatgggccgggcgacgagccgtatgtgctccaggcgagttatcggtttagcattgacggcaagaagagtgcgtagagagacctttggaagtcacgaggatgaagagagagacggatataatacgctttgacgtctgtattgaatctatacctctaatgtgctctgtgagaagtctggaagctggtacctgcccgggcggccgctcga

SEQ ID NO: 189 - DNA, 171 bp, Trichoderma reesei
tcgagcggccgcccgggcaggtacatcgtcaccagtcaccgcttagcgtcactcgccatcgtgcaaacctgtcgtttgccccggcttatacagatcctgtccgttttgcctgatgtaacatcacaagagaaggtattgaccaagcgtatggtacctcggccgcgaccacgc

SEQ ID NO: 190 - DNA, 276 bp, Trichoderma reesei
gcgtggtcgcggccgaggtacggtttgccactgcagaaggaagaagcaacggctgttttgcaacaatcaccgacgattttaccttcaaggctattgacgcaatctactgccggaatttgggaaatgaaaaatgccagcaaaggagatgatttgagtggtaggactggcacggtggttattgagggggcttggtgagggcaagttgcgtgatagacaccgcggtggcaccagggtcatcagaagcagaagatgatgtacctgcccgggcggccgctc

SEQ ID NO: 191 - DNA, 257 bp, Trichoderma reesei
gcagccgcccgggcaggtacgtagggcaaagccgaccgtctcccaaccctgatatcaatgccatggtatcctaactcaacaccgaacaatgcaagaatgaaagaagaaacaacccaatcctcggcctcccctcacttctgaccaacaagcttcttcaccttctccagcaacagcgagctctccctgcccagcttcttcttgccgtccttgtccctcgtcttggccatggccttcttgtacctcggccgcgaccacgc

SEQ ID NO: 192 - DNA, 534 bp, Trichoderma reesei
tcgagcggccgcccgggcaggtacggagtatgctaaaaataaaaaataaaaacaatgtcgctgaaatgcgtttctcagctttagacgaccacccaaacaaaagacattccactcaatgattgttccgaaacgacggaaaaaggttcatgcttcagtgcccgaaggatgcgacgtgatgcctgcaaagccaacatagagagagcaagggaaagaaacaggaatgactggaaatcgtgatatctctgaccgagcctcgctcatgaatcatagttgatgccaaatgaacaaggtttcatcagcatccaaacccgtgcgccttgtaaaactccttaagccgaataaacaaatcgaaatgaaagaaagacaaatgacatgttcttcttgccacgagcaatggcgcagcctgatgtgactcggtgttgcttgtttgcgcaaggtaaggtagtagccagtcatgacagaccaagactggaacaaggcgtgcttgcttgtgcgaaggtggaggggggagaagcacctcggccgcgaccacgc

SEQ ID NO: 193 - DNA, 688 bp, Trichoderma reesei
tcgagcggccgcccgggcaggtattcgctcgtcgataccctgcgcgtttcgataggcgaatttgcatcaacacaacaccgcgatcatggctgacgaatacaacgccgaggaggccgctgagatcaagaagagaagaaccttccgcaagttctcctaccgaggaatcgaccttgacaacctcctcgacctctcctccgaccagctccgcgatgtcgtccacgcccgtgcccgcagaaggatcaaccgcggcctgaagcgccgccccatgggcctcatcaagaagctccgaaaggccaagcaggaggccaagcccaacgagaagcccgacctcgtcaagacccacctgcgagacatgattgtcgtccccgagatgattggcagcgtcatcggcatctactccggcaaggagttcaaccaggttgagatcaagcctgaaatggttggccactacctgggcgagttctccatctcatacaagcctgtcaagcacggtcgacctggtatcggtgccacgcactcttctcgtttcattcccctcaaataagaaggcgtgtggtcttgggtggtttctgcattctcggacattttcgggcgaaaaaggactggttttggtagacggaggaaagccgctactgaagttgttgacgacaatgatttctatgatagtacctgcccgggcggccgctcg

SEQ ID NO: 194 - DNA, 426 bp, Trichoderma reesei
cgagcggccgcccgggcaggtcccagcgcctatccgcggacgacgacatcgagtcctcaaactgcggccctccgttcatccgccccttggaatcgtcctcctcgatacccaaccagacgccgtagtttccgtgtgttgagaagagcgcaatagcgaagagcagaaaagaaaccggagacgagacgagataaacaattattatccatacacagacttcagcaccatggcccagaagcgtcttatgcaggagctgcagtctcttcagaaggagaaatggatagacatcacaacagacgaggccaaccttctcaagtggaggatcggtctgtgggtggtcaatcctgacagcgtttggcatggggcctttctcaaggccgagatgagatttccgtccgactacccgtacctcggccgcgaccacgctaa

SEQ ID NO: 195 - DNA, 300 bp, Trichoderma reesei
cgagcggccgcccgggcaggtacgagctgatgtaaaaatcaagcggaagaatacatgaccatatgatccttttgttaccccccaatgttcgccgtgccccatttccatgacaagaaataagagagagaaaaaaaaagttgatttggttttcgattggatattatccgtttatcggacaatgccatcgaagcggctcttgaaccaccggacggtctcgtcgcgcttgatgcggtgggaggcaccgatccggctcttcatgcggcggcggcgggtgacgcgcaccttcggccgcgaccacgc

SEQ ID NO: 196 - DNA, 209 bp, Trichoderma reesei
cgagcggccgcccgggcaggtctgcagagtcgtcggccagcgagagacatgaaagagagcgacagggtgcgcggcaggctgtgtatcaatgcagcagaaggctattggagtcgaacaggaagagagaagcccggcttgagtctcggggtcgcggcgatggcgatggtcggattgcgctgatatgcagagcacctcggccgcgaccacgc

SEQ ID NO: 197 - DNA, 443 bp, Trichoderma reesei
gcggccgcctggggcaggtacgtggccagataacggttcagagagccgaggccaggcaggcggaagctctcgggaatggcgtgctcacggtcagagtttcgaatgttgtcgagaatggcgtttcgctcgtcgtcgcccgaaacctgaggggccctgaagccggcctgttgagagtcgactgcagagggcgatcgaggggccgggacctctgagccaggggccggaagcgagttcatcatggattggagagcgggcacgaggccattggtgtttcgaccagtaaagggaggcagctggccggcatgatgctgcagtctcgacgactcgaaagagccagaggcgctcgaggtgatggagtgcggcttgggctcggccatgaaattgtcccactggacctggggaagggcgatggcgccggatgggtacctcggccgcgaccacgc

SEQ ID NO: 198 - DNA, 480 bp, Trichoderma reesei
gcgtggtcgcggccgaggtacccaatagtgacgttctgtaatattgccaatatgtgtttcactctcacgtaactgaagttcacatgagggtaaaaatgcacggcaagatttttgcttttcaaaagcaattcggaatcctcgggcaaaacttatagcttcctaaataagcttggagagtgtagttcttctcgtatgtctggagactatacataagctcttcactgatttctgaatggtcccatttggtagttgaaacaaattcacaagcccggccaccagtgcacttatatgttgttcttcggcagggaattccaccaaaaaacactgttgagctgtcccttgttgctgatatgcgcatcatattgtattgtatggatgaccaaggttcatgaaagtcattggattcaataccgtttctgggaatacagtaaccaactccattgacgcttgtattggggtacctgcccgggcggccgctcg

SEQ ID NO: 199 - DNA, 381 bp, Trichoderma reesei
gcgtggtcgcggccgaggttactcatcctaccgcgatggctctggccgatccccaaccgaaaggacgtggggtcgtgacgattctcgaactagggatgatagaaacgatggcttctatcgcgcaaggtctccaggcaatgagcgccgagaccgacaacgttcgcgttcccctcctcccgttgatcgatacgagccgcgacctcgtcgagatggccgagacggccgagatgacagagacagagacagagatgatcggcgtcgtatcacttccccgccggcgaatatcgatcgctacgtgcctggacaggatagcggatcatctggccttgctgtcaaccctctgcaggatccagccaaacttccgtacctgcccgggcggcc

SEQ ID NO: 200 - DNA, 238 bp, Trichoderma reesei
gcggccgcccgggcaggtacgtcttgaggatttctcggttcgcgaatccgccctccacggcatgtattttccacgccaggtttagcgcgtccaggaaggacgtgttcataccctggccagccttgggactatgcgtgtggcaagcgtcgccgcccagaaagactcgctcatccagagtgtatctgtctgagattccctggccaatgggatacacagagtacctcggccgcgaccacgc

SEQ ID NO: 201 - DNA, 554 bp, Trichoderma reesei
tctctctctctttgattttacaacgcaattcctacgcagctggaaacaggcagcgagcaaaaccctttggttctgagatggccaccatccaaaacaataaacacctggtccggaagccttttatgagaaactagaacgggactctgagctggatcgacacagtctcaatgattatatcaatgctatgcagggaagaggagaagacgaggggaacgaggtaaccgatgggggcggcaaagggtggttgtgaccgaggacagcccctcacaatctcctcttttctacgagttatttttccttttttttttcctcctttttcttttcagctctcttactttttaataaagcagtcgagcggtttttttccatcgaggcaggcgatggatgggagtgggagggacagaaggggacgagagatatccagacaaaggggtctactgttggttttcctgggaaagccggctccttttagcatgtattaatttctgatttctctatggttcaaaaaaaaaaaaaaaaaaaaaaaaaagcttgtacctcggccgcgaccacgc

SEQ ID NO: 202 - DNA, 230 bp, Trichoderma reesei
gagcggccgcccgggcaggtaccagatgcatgcaaggacccgtgacctcccccccagtgagtgattgcgtcaagacaacaaagatggacgcaggaacaaagaaagaacgccagatgagcctttcgtggccgctaaatcaatgcaagagtcctccaagaagaaagccaaaaacatcccgagagagccgcgttatccatggccgaggggtggtacctcggccgcgaccacgc

SEQ ID NO: 203 - DNA, 333 bp, Trichoderma reesei
tgcagaaattcgcccttttgagcgggcgcccggggcaggtcaatccctctcgatgacatctttcgtgtctaagggggagggtttattgtccatccatcctatggatattccaggctcggatcaagcctgaataatgtgaaaaataccccatgggcttggagtgatacgtggaacggtttgtcatttttttggatcgggctgggatgtattttggtcatgaggcagagtgcccagtagataggatctacctatgtgcagcactgtaatttaagatggattttggaaaaaaaaaaaaaaaaaaaaaaagcttgtacacctcggccgcgaccacgc

SEQ ID NO: 204 - DNA, 381 bp, Trichoderma reesei
tcgagcggccgcccgggcaggtacccaaatattcttcggggcaaagtagaagacggtaggagcaacagtgccgggagtcattttgttctggcttgccgttgccatattggaccagtcactgaacagaccaaagttcattgaaccccagattgttcctgtgtcatgagtcgagccccatacaagatgctggccattataaatgacatgggagaagtctttcagcgagacccagcctgatttcgggctggctaaagcaccagtcgaattccagcggtatgtggacggaagcgtacaggtcgccgatgctgccgcgacaagagttacaaagctcagcacaacggcactgagtgctttaagctccaacctcggccgcgaccacgc

SEQ ID NO: 205 - DNA, 401 bp, Trichoderma reesei
gagcggccgcccgggcaggtttttaggctcaaaacttcataatggagcttaaagcactcagtgccgttgtgctgagctttgtaactcttgtcgcggcagcaccggcgacctgcacgcttccgtccacataccgctggaattcgcccggtgctttagccagcccgaaatcaggctgggtctcgctgaaagacttctcccatgtcatttataatggccagcatcttgtatggggctcgactcatgacacaggaacaatctggggttcaatgaactttggtctgttcagtgactggtccaatatggcaacggcaagccagaacaaaatgactcccggcactgttgctcctaccgtcttctactttgccccgaagaatatttgggtacctcggccgcgaccacgc

SEQ ID NO: 206 - DNA, 218 bp, Trichoderma reesei
tcgagcggccgcccgggcaggtacttcgtcatgaaggacatgatccagcaggcggcctttgacaagctgttcatccagttctacaacaacccggtttgtgacgccattcctggcaacaccgccggcgacaagttcaactacgatgactgggaggctgtgattgctggcagcgccaaaagcaagtcggccaagctgtacctcggccgcgaccacgctaa

SEQ ID NO: 207 - DNA, 213 bp, Trichoderma reesei
cccgggcaggtgtctacgatttcttggttcaacgattcttggaagtcgtgggttcggcctccgttcatgatgctgatataagggggaaataccaagtgttgggatttatctatttttttggtttacgtcgacgggatggggggaagcgatattcaattttttgggatgtatagagaatgggtctcttgggttaacgggacatgcaagctcggt

SEQ ID NO: 208 - DNA, 413 bp, Trichoderma reesei
gcgtggtcgcggccgaggtaccagcgactataacaagtttgacttttacaaataagctgtcgatatctatatatgtaattaggattgtcacggacgacgaagatggaagcggatcatattgaaatgaacaggggcaaggggattatcaactatgaaatacagggggctttgttgctctcgatatgcatcatggaggggatattggtagaaaacgtgggcggctggggagcgctgaccaacagtttggggggaatgagacatggagatgaacagacaaagccatgttgaaaaggaggtagctgttggcgtcgtcttcatcacaatggatctacggcgttgaaatctatggggctcgtcggtcaaaaaaaaaaaaaaaaaaaaaaaagcttgtacctgcccgggcggccgctcga

SEQ ID NO: 209 - DNA, 723 bp, Trichoderma reesei
gagagggcactatggaactggatggatcaatcataggagttgctatctcgacctttctctccgacatgaaagccttccccggcctgatattggacgacgagaaatggtattgccggcctcgatagactgttacgagcgcctagctgcgacaaaatgagccttgtttgctcgtttcttcatgagccatagaagacctggattttccgtcacggcttggcagacaacaagcattgatgcgggatgatcatcatcatgccacaggattctacacttgcgcgctttttcaccacatctgaactttttcttttccctttgcctgttctcctttcgcgaaagaaaaacaaacatgaatccaggagttggggaggtccatttgaaagtttgcaaaatatcatgacccgtcctctattttcttgccttttttctcatgcctacgacattgtgcggctcggttctggttcgattatcttgatgtccgctttcatcgcctcgttttcgttttttattttctcaacttcttcgctcttgagaatttccatgtcttcctctttttttctttttttttccatacgcgagatttaaagcatcttgtgcgcgaggcggcaggtggacaggggaccgaaaacgacacagattgcgacagttgttactcagtagtgagagaattctcttctttcactctgaatttcgaattctcctgcagtacctcggccgcgaccacgc

SEQ ID NO: 210 - DNA, 293 bp, Trichoderma reesei
taatacgactcactatagggctcgagcggccgcccgggcaggtactcattgctcaacattccattgcttttgccagtgtaaacagagagactgagagaatacactactctctcactcaaatgattccaacatgctcccaaacttcctttccttcccgctatgcatatacataatcatttagaccggtgtcttcccccatcaccccttctgaggctctcacgagtgtagagcatgagctgcgagcaacgaggcgcagttaccgccatgctggcacacctcggccgcgaccacgc

SEQ ID NO: 211 - DNA, 447 bp, Trichoderma reesei
tcgagcggccgcccgggcaggtcctttcatacaagacaaacagcgttagaagcctcaggctgccttcaagatgatttaaacaaacctctttagagcgtttcttccccctccgtcaaaattcagtcccaggacattaacaacattctccccactcaatcttctcgttcagctcaccattcggtcgacctgaacttcagccctgctttgaatagcatcagcacgagttctctcctcaacgccaacatttcctctcaagactttcaagtcttcaccacggattcccagtcaacatggcttcccaactcagcttccgccctgccggcaccatccgagcatctgtccctgaaccccgtcgagaatccccagcaggactttgttctgttcgacaacccgccgcctcgtcaacatcataatagtcgcattgcagtacctcggccgcgaccacgc

SEQ ID NO: 212 - DNA, 414 bp, Trichoderma reesei
gcgtggtcgcggccgaggtactcgtccgccgtgttgccaaggttgcgagacgtgttgaacggctcctcgacgcaaagctggttattcagtgcatagtgccactttttctccgccttggtaatcaacttgccctgccgcacagaaagaacgtgcttgtcgtagtcgaactcatgcgcgtagaatcggaagaactggaagaggagttccgcctcggacgatttgttcttgctaccgaatcccttgatcttcttcaggttatcggcaaagtcgctgacagttccatctggcctggtggacttgtatggcagttgatgcaacgctggtaatacagcagggttccgcagttgcaagaatgcgatgataagacatatccaagtgtaggaactgagtgtacctgcccgggcggccgctcga

SEQ ID NO: 213 - DNA, 521 bp, Trichoderma reesei
ggagcggccgcccgggcaggtacttctgttcgtggctggcatccatggccaaaggcgctgaagagtagtaatccatgatgaggatgtgtgtgactgtgtgagagagccgacaagggcgagaggtggggatgagacgacgcggaagtcgacgtcaaagaagcgaaggagacggttgacgacccgagcaaaaaacgagagaaacaagaaataacgaggacaaggaggaagaagcgaaacaaaagcaagaatacacaagtcgtaaggtgctgatactgataatctccaactaatgcggatgttagcgtatggcgggcttttattgactgcagacgggcagtgatgatgtgaggcggggctggtgagggaaagagggaaaaaaaaccacagaaacgcgaagacgatagttcaagacagcgttaaagagacgagcggagggggcagtcgtgaaacgcagagcccatgcaggtcatgaagtcgtcaagcaagcagcgtcttgtggaagacctcggccgcgaccacgc

SEQ ID NO: 214 - DNA, 326 bp, Trichoderma reesei
tcgagcggccgcccgggcaggtacaagaagaacatggagtgagcgcagatagtctcagccgtgccagtgaagagatatgcctgggcgtagatcttgaagttgatgaggtggtcctttttgtggttccgaggaggcagcgacaggaggtcaaactcttccttttccatgatgagcgagagggacaggaacagatcggtgaagacgcagatgatgatcatgaggaacgagcttagaggcaggggaacgccaaagaagacattgacgaggacgggccagatctccgaccagctaccggcgggaagaaggtacctcggccgcgaccacgc

SEQ ID NO: 215 - DNA, 389 bp, Trichoderma reesei
tgagcggccgcccgggcaggtacgtggacgcgtaggcggcaccgtccagacagcagttcttcgcgcaggtctcgttgtcaggacatagggtcgagctccaagtgttgccatcgtagcagttcgtgctgctgttcgtagcgtgagtccagcgccagttggcgtcgatgaccacggagcctgtctgttgagtgcacgtgccaccagacgagcatttctgccatgtcagaggcgggtgagtctccgattggagagtgcaggccgactgagcacgagctgtggccaagaaggccgagatgacggccaacttccgatacatgatgcgcagtccgcggttgactattgggtttctgtgcctcaaaagatggtgtacacctcggccgcgaccacgc

SEQ ID NO: 216 - DNA, 255 bp, Trichoderma reesei
cgagcggccgcccgggcaggtactgttcaaacaggttgaggagcatctgggtcgtgcaatatccaggcgagagtgtgttgacacgaatgccgtgcacaccccattcagcggccaagcttcgagtcatttgcatgacaccagccttggaggtgttgtatagtgatgcgaacatgccacggttggcgatggtgccgctcatgctggcaatgaggcagatgcttccaggcgtcccaaacacctcggccgcgaccacgc

SEQ ID NO: 217 - DNA, 305 bp, Trichoderma reesei
gcgtggtcgcggccgaggtacggagttaccacgagcggtaacagcctctccattggctttgtcacccagtctgcgcagaagaacgttggcgctcgcctttaccttatggcgagcgacacgacctaccaggaattcaccctgcttggcaacgagttctcttttcgatgttgatgtttcgcagctgccgtgcggcttgaacggagctctctacttcgtgtccatggacgcggatggtggcgtgagcaagtatcccaccaacaccgctggcgccaagtacctgcccgggcggccgctcgaaagggcga

SEQ ID NO: 218 - DNA, 435 bp, Trichoderma reesei
atcgcacatcattgtttgaagccccggtcacgaaagccttacaggaacgatgggtttgcgtttgtgagaagctgcacaaagtaggcttggaaccaagcaccagcttgaggcgccggttgcaaggcatctgggagcgcacagtgggagtcaaatcgtggcgcactgctgtcgctggtgccgtcacactcgccgcctggcttgacccagacaaacgaatccagcaacgagtccccagtgtttgcggatgggcgaataccaaatccggtgccgatcacattgcaccagtctccccactgttgctgtccggtaggctgctttcccgatcgaccttgatcagtgatgaagaaggcgttggaccagccgtgattggcaagaagaggtccaatagcgtggatgtacctcggccgcgaccacgctaagggcgaattctgcaga

SEQ ID NO: 219 - DNA, 579 bp, Trichoderma reesei
tgagcggccgcccgggcaggtacaagttcataaaggttgaacccatccccatatcctcaaagacccccccctgcccgggcgaacaaaagcccaaatcacagaccgtccagactagaaagctgctgttccacgtgcctcacccgagagagttccatccatggctccccaaagttccagatgatagtgtgtctcctccctcagcatcttacaagaacccgacccgtagctgttttcgtcggaaatggaaagagaaagggaaaagggaacgcagaagaatctcaaagaggcgttaagaggaaacagggatacccacttctacccattcgcaacattgccacttgaattcgcccaaagaacccagtcattctgccctgatctcggtgactctccgtggcctccatgaatccatctttcgttgctgccctcctccaacagattggcaaaatacaaatggcattggagaccttgcgagattccaagtatggccttcaggatcccaaggtctgtctgcgaagatgacttgactgtggtgatgaagggtcattcttgagcgtagtgctgtgtacctcggcccgcgac

SEQ ID NO: 220 - DNA, 206 bp, Trichoderma reesei
gcgtggtcgcggccgaggtacatgcccaaggaagatgctccacgggcactgattatgactgcggaagccagcgccaagaacaatgccaaactggagtaacccggcatgaagtctgaccgggtagtatgagggttcatcgtcaccttgatagaataatagacgataaagcaggccacgggcaggtacctgcccgggcggccgctcga

SEQ ID NO: 221 - DNA, 241 bp, Trichoderma reesei
gcgtggtcgcggccgaggtactttgatgccaactgcgaccaaaggctcgtgaattgagcattagtagggccgccctgaccaatgatcccaccgttccatcgagcataattgtggatgtcgacgatgcagtatgcgcccagagacaggcacccctgaacaagctgatcatacttggaaatgctcgtggaatcaagattgccgcccaaattgttgttgacgaggtacctgcccgggcggccgc

SEQ ID NO: 222 - DNA, 344 bp, Trichoderma reesei
gcgtggtcgcggccgaggtacttgtgccaacctcgctgttggtaaagtcggcgacattgcttggcgcctccagcttgcgtctgcattcattcccgctgttcccctcgtcatcggcacgtactttgatgccaactgcgaccaaaggctcgtgaattgagcattagtagggccgccctgaccaatgatcccaccgttccatcgagcataattgtggatgtcgacgatgcagtatgcgcccagagacaggcacccctgaacaagctgatcatacttggaaatgctcgtggaatcaagattgccgcccaaattgttgttgacgaggtacctgcccgggcggccgctcg

SEQ ID NO: 223 - DNA, 118 bp, Trichoderma reesei
cgactcactatagggcgaattgggccctctagatgcatgctcgagcggccgccagtgtgatggatatctgcagaattcgcccttagcggccgcccgggcaggtactttttcactatcg

SEQ ID NO: 224 - DNA, 328 bp, Trichoderma reesei
gcgtggtcgcggccgaggtgtggcggcatcagctatgctaactcagttgtgaacggaaccaacgccgcggcggcggcaatcaacaactttcacaactcttgcccggacactcagctggtgttggtcggatactcgcagggtgctcaaatcttcgataatgccctctgcggaggaggcgatcctggtgaaggaattaccaacactgctgtccccctaactgcgggagcagtttccgctgttaaagcagcaatcttcatgggagaccctcgaaacattcatggcctgccctataacgtcggaacctgtacctgcccgggcggccgctcga

SEQ ID NO: 225 - DNA, 606 bp, Trichoderma reesei
gcgtggtcgcggccgaggtacaggttccgacgttatagggcaggccatgaatgtttcgagggtctcccatgaagattgctgctttaacagcggaaactgctcccgcagttagggggacagcagtgttggtaattccttcaccaggatcgcctcctccgcagagggcattatcgaagatttgagcaccctgcgagtatccgaccaacaccagctgagtgtccgggcaagagttgtgaaagttgttgattgccgccgccgcggcgttggttccgttcacaactgagttagcatagctgatgccgccacatgaagcctgaccaccgcacgccgggtagacaattgcctcggatgtggttccgggatgggcttggatgaccaagtttacaacggtagcggacgagccatatccctgactcactgtcgtttcacgggcgccgaagacgtgaatcgccgggcattgtcgcttcacaacggtctctccatctactgggctgccagtggcaaggaaagcttggctcagcaaaagagtaagtgtttctttgactgaaggcattttggctcttgtaacaggaggaattatttatacctgcccgggcggccgctcga

SEQ ID NO: 226 - DNA, 581 bp, Trichoderma reesei
gcgtggtcgcggccgaggtagccaaaatgccttcagtcaaagaaacacttactcttttgctgagccaagctttccttgccactggcagcccagtagatggagagaccgttgtgaagcgacaatgcccggcgattcacgtcttcggcgcccgtgaaacgacagtgagtcagggatatggctcgtccgctaccgttgtaaacttggtcatccaagcccatcccggaaccacatccgaggcaattgtctacccggcgtgcggtggtcaggcttcatgtggcggcatcagctatgctaactcagttgtgaacggaaccaacgccgcggcggcggcaatcaacaactttcacaactcttgcccggacactcagctggtgttggtcggatactcgcagggtgctcaaatcttcgataatgccctctgcggaggaggcgatcctggtgaaggaattaccaacactgctgtccccctaactgcgggagcagtttccgctgttaaagcagcatcttcatgggagaccctcgaaacattcatggcctgccctataacgtcggaacctgtacctgcccgggcggccgctcga

SEQ ID NO: 227 - DNA, 225 bp, Trichoderma reesei
gcgtggtcgcggccgaggtcacgctcctcgtcctcctcggcttctcctcacgaaggcttcttcttcttcgctccgctgcttctcgtcgacacagaaaacaggcacgatggcgtctcccacgctcaagctcaacagcggatatgacatgccccaggtgggctttggcctctggaaggtcgacaatgccgtgtgcgcggacaccgtgtacctgcccgggcggccgcc

SEQ ID NO: 228 - DNA, 349 bp, Trichoderma reesei
gagcggccgcccgggcaggtgtgccgtatggggaggggttgaggaggtgacgaggggctataaaacaaatcctgaatctttcgttgtgctcattgggttatgggagctaggatttgatttaaccctgcttgggagcctccttggcctcgatggcggcctcctcacccatggaggtgaggacaacaacgttggtgtccttctcgtcaatcttgaagagcttgttgatcttctcaccaatctcgccatcgggcatgcggacatcgtccttgaggtcaccgtcgtcgttcatcagggagaggaaaccgtcgtcggagatgtcgatcagctggtacctcggccgcgaccacgc

SEQ ID NO: 229 - DNA, 337 bp, Trichoderma reesei
gcgtggtcgcggccgaggtaccagagcctccgccgccgctgagatgggactggcttccaataccgtcaatgggaactccttgagagatccacttggagacgtaagtcttcaacccgttgaccttgccatagttggcgcggtcgagattgtagtcgttgatgtaaagacgggcagaagggtcagcatctcgagcagcacgaaaggcaatcgagacaaactcctcgccgaggagcctggaaaagactgaagagcgcagcgttccatcctcgttgaagatttcattgaccacgtcccaagcacgaatcttgcccttgtacctgcccgggcggccgctcga

SEQ ID NO: 230 - DNA, 627 bp, Trichoderma reesei
caagatcgacaagtctcatgtccacgagatcgtcctcgtcggtggctccacccgtattccccgcatccagaagctcatcaccgactacttcaacggcaaggagcccaacaagtccatcaaccccgatgaggctgtcgcctacggtgccaccgtccaggccgccatcctgtctggtgacaccacttccaagtccaccaacgagatcctgcttctcgatgtcgctcccctgtctctcggtatcgagactgctggtggcatgatgaccaagctcatcccccgcaacaccaccatccccaccaagaagtccgaggtcttctccaccttctccgacaaccaacatggtgtgctcatccaggtctacgagggtgagcgccagcgcaccaaggacaacaacctgctcggcaagttcgagcttaccggcatcccccctgcgcctcgtggtgttccccagatcgaggtcaccttcggcgttgatgccaacggtatcatgaacgtctctgccgtcgagaagggcactggcaagtccaacaagattgtcatcaccaacgacaagggccgcctgtccaaggaggagattgagcgcatgctgtctgacgccgagaagtacctgcccgggcggccgctcga

SEQ ID NO: 231 - DNA, 289 bp, Trichoderma reesei
gcgtggtcgcggccgaggtacttctcggcgtcagacagcatgcgctcaatctcctccttggacaggcggcccttgtcgttggtgatgacaatcttgttggacttgccagtgcccttctcgacggcagagacgttcatgataccgttggcatcaacgtcgaaggtgacctcgatctggggaacaccacgaggcgcaggggggatgccggtaagctcgaacttgccgagcaggttgttgtccttggtgcgctggcgcccaccctcgtagacctgcccgggcggccgctcga

SEQ ID NO: 232 - DNA, 182 bp, Trichoderma reesei
gcgtggtcgcggccgaggtacctaggagtatataacaggtaatacgagtataataagcctttcctctatagcaggtatcattcccagcgcgggtggggaggggttgaatgaatgaatggagagatttgttgttttagttagggcatgtggcgccgcagctctggcaggtctttgtgccggag

SEQ ID NO: 233 - DNA, 183 bp, Trichoderma reesei
gcgtggtcgcggccgaggtaccactgctgcaactccttcttatcaaaatgagtcgacttctgcagctcggcgagctgctcctgcgagagttttgactgcgatttgcccatgatatcttgggccggtagaagagaggatttgaacggatcggaacaggagacgccgcacctgcccggcggccgc

SEQ ID NO: 234 - DNA, 320 bp, Trichoderma reesei
gcgtggtcgcggccgaggtacgactacaagcagaagaagtgcatctgcaagaagaagggccaagtgtttgactccaagcacaagacctgtgcttgcccctacggtcaggtgttcaacggaaagcaatgtgtctttgactgcggacgggacgcccactacgacaactggcaaaagaagtgtgtctgcaacaagaagggcgagatctttgattcgcacacaaagacttgttcgtgccccaaggccaagtctttaacggcaagcaatgcgtgtttgactgcggcaaggaagcacactacgattctaagcaaaggaagtgcatc

SEQ ID NO: 235 - DNA, 647 bp, Trichoderma reesei
gcgtggtcgcggccgaggtacggaggccgctgttgaattgcgaaagcgacagaaagcattggttgatgaccgctcggtgcccagggggagaagctgtgtcaagctatccttcccgagtatgcaatcgatgccggcgaggatggtaaatgagcgactcgggtatcgaaggagcaggtagcatgctcgagagggtcaagtgtcggaactgctgcggcttctaatgacgatgcattgaggaagcaagcaggatggccgtcttggtcgcagaaggtgtcgtcgttctggggctcgcttcttcctcttcttcttcttcttcttcttcttcttcttcttctttcttcttctttcggttgcgtaaagacggatggcgccggtgcaattggaacggcgcagcaggagggcgagaaaggagaaacacctgcccgggcggccggacgctaaggcgaattccagcacactgtggctgttcaggagggatcggaacaaatttccatgccaccacctggggggggcccggttttacttaggtggggaatccccaaaaccttccgggaaaccccaaaggcttttggaaatggccattaacctctttggaagaggttatttcctaataagggtggtccacccttaaaataagcctttgggcg

SEQ ID NO: 236 - DNA, 391 bp, Trichoderma reesei
gcgtggtcgcggccgaggtactacggcctgaccgaggccaactactacaccgtcctctttggtgtctcccgtgccattggtgtccttccccagctcatcattgaccgcgccgtcggcgcccccatcgagcgccccaagtccttctctaccgacaagtgggccgagctcgtcaagaagctgtaagggatgacgtttaggatgggtggagcaaaggcaaaaatggtgcaatagagggagtggtttcttctttctttgagggcttgcgataagggacaaaaagttgaggccctattgggcaggatttgatcatcgactaggatatagacagtctgtggatgacacagcgacggccagaacggcgcttaattgtacctgcccgggcggccgctcg

SEQ ID NO: 237 - DNA, 421 bp, Trichoderma reesei
gcgtggtcgcggccgaggtacgctaatgccggctactctattgccacggacgttttgatcttgttgctgcccatgcagcccatctgggcgagcaagctgccccttgctcaaaagagggctctgatggttgtctttgctcttggtagtttcgtcactgtgacatccatcatgcgagccaccactctcaacttttcgactaccagtcccgatacgactttcgatatcacctccactctgtggaccatcatcgaagagaacgttgccattatctgtgcctgtctacccatgtgtcgcatggttctggccttcctcttccccaagatcttcggcggcaacacctccaagggttcgactggcgcctcgggcggtctgggctccgaacgcaacaagtacctgcccgggcggccgctcccgaaagggc

SEQ ID NO: 238 - DNA, 373 bp, Trichoderma reesei
cgagcggccgcccgggcaggtactgggaatacattgcgagtaataagggttatatgatacacaagtcgcacctccaacacaagttgttgggccagaccaaccaattccaccacattgtccccagactggagattgggcctggattgggatcgctaaaaggagaagagcaaagaagcgggaagccatcttgttacttctgaacaacgaaatatcgacttcggctttgctaaggtgctagcatctagtttctatgagcgctgctctattccttcttatagctttctgtagccgctcgtccggccaaacatatccccagtctcatgggcaatccatcaagcatgtacctcggccgcgaccacgctaagggcgaaat

SEQ ID NO: 239 - DNA, 171 bp, Trichoderma reesei
gcgtggtcgcggccgaggtacagaggcatagactgatatacaatcggttgaccaacgccacggcgagcccgcttccacaggctccagccatcccaaccaccagttcatccggaccaaccaggccagcatagtctcaagaacaacgacgacacctgcacgggcggccgctcg

SEQ ID NO: 240 - DNA, 348 bp, Trichoderma reesei
gcgtggtcgcggccgaggtactttgcctggtcgctcatggacaactttgagtgggcggacggctacgtgacgaggtttggggttacgtatgtggattatgagaatgggcagaagcggttccccaagaagagcgcaaagagcttgaagccgctgtttgacgagctgattgcggcggcgtgatggaaaaagtttttgagttgatgatacctgcaaagggatgctgaagatgatgatgatgtatgaacacgaaagggatagtattatagcaagctaggataacctgatgcttcttcaaaggggaaaaaaaaaaaaaaaaaaaaaaaaaaacctgcccgggcggccgctcga

SEQ ID NO: 241 - DNA, 353 bp, Trichoderma reesei
ggggcccgccagtgtgctggaaattcgccccttgagcggccgcccgggcaggtacgtttggaagtgtctctctttagaagagtgagcttgtcgccggtcgtgccatcagagccaaggacatagttccaggaaagggctgtagcattgtgaacagtcaagccgccaaatccgaaattttgttggtcaaggtaagtggtgatatccagcaaaggacttgagccaagagtgctgtggctctcaatgtttcctgccgctccgttgatgatatgggccattgaaacacccggatttgtccaataggtattgttattgatgatggaggcctcgtcaatggtacctgcccgggcggccgc

SEQ ID NO: 242 - DNA, 255 bp, Trichoderma reesei
tcgagcggccgcccgggcaggtaccaaccctgcctctcgaagtatgcctttgctttgtctgccggtccaaagtagatctgacggccctcatatagaactgtcgccttgtcgaaaagatcgtagatggcttgactggcctggtaaatggcaacggcatttgcgtggttgcccagatcggcggacgttcggagcgctttgacgaacttgaaagctgttgcagagtcgagacctcgagtacctcggccgcgaccacgc

SEQ ID NO: 243 - DNA, 483 bp, Trichoderma reesei
gcgtggtcgcggccgaggtacatctatgattgcccttatggtttttttgccccatctttctttcccctcctgtaattgtttgcaatggttcatgttgtctacctaggtatgtgaagagactgggctccacaggtcccgatctgaaaccagcagccctcaaagaccgtccagagcaacacataactcaatatccgaaaagagtgtcgagaaggaaataggcctcaagcttctgcctgatgacgagacccgtggattgatcaatcggggccttacgcggaaagaagattgtcgactgtcagcggtgctaccatcaatagtcttctccacggctaatgacctccttcacggtaggtctcagcaaaatcgtatgctcaaattgggccgtgtaagaccctttcttatcgaccagaggcggatagtcttcgacgatgcccgacttcacaagagtgttaagaccgaggaggtacctgcccgggcggccgc

SEQ ID NO: 244 - DNA, 317 bp, Trichoderma reesei
cgagcggccgcccgggcaggtccgggcaggtactcaaccagtgggttggtgctccagccatagacggaaagcaggccagttccgctgttgacactaaaagagccgccaaagttgatgggagcagaagatccagtcgtccaaccaacgcccacaacaaagtcatcttgagtgttccagttcactgagaagccagtgttggaaggcgaatagctgacttgtccgccagtttggtagttttggtcgtagttgatgctagcacgacggcgatgatcattgtgagctccaagaacaaagtcgtacctcggccgcgaccacgc

SEQ ID NO: 245 - DNA, 308 bp, Trichoderma reesei
tcgagcggccgcccgggcaggtactcaaccagtgggttggtgctccagccatagacggaaagcaggccagttccgctgttgacactaaaagagccgccaaagttgatgggagcagaagatccagtcgtccaaccaacgcccacaacaaagtcatcttgagtgttccagttcactgagaagccagtgttggaaggcgaatagctgacttgtccgccagtttggtagttttggtcgtagttgatgctagcacgacggcgatgatcattgtgagctccaagaacaaagtcgtacctcggccgcgaccacgc

SEQ ID NO: 246 - DNA, 372 bp, Trichoderma reesei
gcgtggtcgcggccgaggtactcaaccagtgggttggtgctccagccatagacggaaagcaggccagttccgctgttgacactaaaagagccgccaaagttgatgggagcagaagatccagtcgtccaaccaacgcccacaacaaagtcatcttgagtgttccagttcactgagaagccagtgttggaaggcgaatagctgacttgtccgccagtttggtagttttggtcgtagttgatgctagcacgacggcgatgatcattgtgagctccaagaacaaagtcgtacatgccacgctctgtgacgttgacactgctctcaggctcgaggcctgtgggcatcgccagagtacctgcccgggcggccgctcga

SEQ ID NO: 247 - DNA, 308 bp, Trichoderma reesei
gcgtggtcgcggccgaggtactcaaccagtgggttggtgctccagccatagacggaaagcaggccagttccgctgttgacactaaaagagccgccaaagttgatgggagcagaagatccagtcgtccaaccaacgcccacaacaaagtcatcttgagtgttccagttcactgagaagccagtgttggaaggcgaatagctgacttgtccgccagtttggtagttttggtcgtagttgatgctagcacgacggcgatgatcattgtgagctccaagaacaaagtcgtacctgcccgggcggccgctcga

SEQ ID NO: 248 - DNA, 141 bp, Trichoderma reesei
gcgtggtcgcggccgaggtaccattcgcagggcgctctcggccgcttcgaaggctttttgacaggcctttggagcgcagccttcgccgttgtcggaccagaatacatctccatggtagcagccgaagcccagcgaccacgc

SEQ ID NO: 249 - DNA, 237 bp, Trichoderma reesei
gcgtggtcgcggccgaggtcccggttcaagcatccgatctgcgaatttcgatctagtcaagaacaacacagctctcacgctacatcacacaaaccgtcaaaatgggtaaggaggacaagactcacatcaacgtggtcgtcatcggccacgtcgactccggcaagtctaccaccactggtcacttgatctaccagtgcggtggtatcgacaagcgtacctgcccgggcggccgctcga

SEQ ID NO: 250 - DNA, 233 bp, Trichoderma reesei
gcgtggtcgcggccgaggttttttttttttttttttttttttttttcatagataataataaagtatatgtataactggatgaatgagagatgaagaaactaagctagttataagagtgtgtgcgaggatgaaggcacctgtcacgactgatatgtgtcaaggtgtaacaccactatgtaacggattgtcacatgaaggaatcaggatgtcgggatacctgcccgggcggccgc

SEQ ID NO: 251 - DNA, 435 bp, Trichoderma reesei
cgagcggccgcccgggcaggttttttttttttttttttttttttttatatggataactggatgaatgagagatgaagaaactaagctagttataagagtgtgtgcgaggatgaaggcacctgtcacgactgatatgtgtcaaggtgtaacaccactatgtaacggattgtcacatgaaggaatcaggatgtcgggattgcccccatgtaatcagggacctcggacgggttggaccacatgctgggcggctcccatccagatacccaattgatgcccctcgctggcaccgcgatattagtgagaccaaaggcagcaatgatcttcttgccagcggctgtcttctggaggttggcatactcctgctgtgacgtccggccgacgcccgatccccagaacagaccgtcaagcatgaaggaaaaggcataaaacttgcca

SEQ ID NO: 252 - DNA, 219 bp, Trichoderma reesei
agcgtggtcgcggccgaggtcccgacgcaaacaaatctcacataacctcgccgcttctctcatcacacaacgccaccaatttgactcatccacctcaacctcaatttcaacttcaacaccaacagaccacacacacaacgtcacaatgtccacccgccccgaaatcgtaggcatggaaaccggccccgagccgccgtacctgcccgggcggccgctcga

SEQ ID NO: 253 - DNA, 346 bp, Trichoderma reesei
cagcaaaaagcctccttgatactcagagaactttttcgccatggcgtctcataccattttccttcgggaggctggtgccgccaaatcctgagatgcgcttgggtaatatcgccgatggcttgttcatcaactacccactctcgaccccgttcaaactcatgcataaacctgaactgttcggcaatgttgaaaataagtcctttgcttgcatataactttttgtagtcctcgatcaattcgcgggcggtcgccacgtctttggcaattggcttttcgcacaacacatgcttgccggcggctaggcagcgtcggacaatcgatggttgtacctcggccgcgaccacgc

SEQ ID NO: 254 - DNA, 464 bp, Trichoderma reesei
gcgtggtcgcggccgaggtcaaacggccatgcttcgtttcatctcaggccaagaggttgtcgagacggctggatttgcccgtcaggtattgcctcaccttccacctctcgacactctcaatgccggcattttgctcagtggtggaggaactgggacgatatcaatgtcttttgcttcgattcgacgagctactgagcttacaatcatcggatccaaaggcagcttctccctaacggatggtcccgacggctccacgttgtcacttgatctcgctacgggagagaggaggtcagagactataagaagtaaaggcgtggagctggagattaaagcttttctagaggccataaaggctgggaaatcggagaagcgggctggtccggaggaagccctgaatgacttggcgatcatagagagtatgtgctcaggggggggcaaagtacctgcccgggcggccgctcgaa

SEQ ID NO: 255 - DNA, 451 bp, Trichoderma reesei
tttcggagcggccgcccgggcaggtaccaaacatcgtctgcgatggtcccagcagggattagaaagtccacgccggagccatgcggtatgatttctttgccattgatgtaaagggtcaaatcgcctccaccaacgtttgtcacccacatgtcaaaggggtaaacgtaatgtggaagctgcatgttgggattgggcaagatcattttctcatgccctgtcgagatcagcctcttggggtgactgttgttctccaaagataaccatttgcaaggagatctatcgagcgagcaatcccacccatctctaccagggctagagggttgagactggcgttccctccgcactaattgttcatcctgatgaatcttctcaaagaggttgatgctcatttccagcgagttcaagtggtatcgaacaaaggagtccagatgtacctcggccgcgaccacgc

SEQ ID NO: 256 - DNA, 195 bp, Trichoderma reesei
gcgtggtcgcggccgaggtctccagctggactccagcgcttttgttgtaattttcgactcaatcggcacctaggcaaaagaccttcgaggcggcccttcacaacgatgcccgtccccttcgaaaccctgctgccgtatggcatcatgattgtcatgttcggcgccacgggtacctgcccgggcggccgctcgaaa

SEQ ID NO: 257 - DNA, 601 bp, Trichoderma reesei
tcgagcggccgcccgggcaggtctgacaccatcgacaacgtcaagtccaagatccaggacaaggagggcatccctccggaccagcagcgtctcatctttgctggcaagcagcttgaggacggccgaaccctctccgactacaacattcagaaggagtctacactccaccttgtcctccgtcttcgcggtggtatgcagattttcgtcaagaccctcacaggaaagaccatcaccctggaggtcgagtcatctgatactatcgacaacgtcaagtccaagattcaggacaaggagggtattcctccagaccagcagcgcctgattttcgctggtaagcagctggaagacggccgcactctgagcgactacaacattcagaaggagagcaccctgcacttggtcctccgtctccgtggtggtatgcagatctttgtcaagacactgacgggtaagacgattaccctggaagtggaatcatctgataccatcgacaacgtcaagtcaaagattcaggacaaggagggtatcccgcctgaccagcagcgcttgatctttgctggtaagcagttggaagacggtcgtacctcggccgcgaccacgc

SEQ ID NO: 258 - DNA, 594 bp, Trichoderma reesei
tcgagcggccgcccgggcaggtccaactgaagtctacactcgttcaaacttccaaacttcaacctctcaaccccaaccaaacaaccaaaccaccacccccaaaacaaaccaccaaaaaccatcaaaatgcgtgccgccgctgttgtcgctatcttcgctgcctccgccatggcccagaccggcggctctgcctctcccaccaacggcaccagcgtcacccacaccggtgctcccaccaccgcccctaccagcggtgccaactccctgtcccagaacatcctcctcggtgtcggtgctgctgccgtcctcgctgccagcctctaagcaacttcaacttttttttattcgaaacctttctctctcttccctgataatttgaggggctttcggggatgtctagctcaagtttgctaggcttcctgtgaagctccttaccgacttcttggggaggggaccggaggaaaagaatatatcatggatctggacgggatggggatggagggggaaaagaaggtcaatttagtttgccggcattagaagtcttgggaggaagagagaagagcggtacctcggccgcgaccacgtaaggggaat

SEQ ID NO: 259 - DNA, 155 bp, Trichoderma reesei
gcgtggtcgcggccgaggtacacctgcacatcgctggccagagatgaggcgctccacagactgcagtttatggcagaaatgggcttctttcctaacatgatgaccaagtttcgaagcatcctcagccaaaagtacctgcccgggcggccgctcga

SEQ ID NO: 260 - DNA, 255 bp, Trichoderma reesei
tcgagcggccgcccgggcaggtacaggtcgtcatgctcatactcggggaacaggggcaaagaacttttccaggaagatgacaaactgatcggccatctcattcaactctttcaggtaactgtcggtatcgacgtagctaaagccgacgccaaccgggttgtcgacgaagagcagattggcaaactcgtgccatgagccgttgttggagaccagggtgttctcgtccttgactctgtacctcggccgcgaccacgc

SEQ ID NO: 261 - DNA, 410 bp, Trichoderma reesei
tcgagcgggccgcccgggcaggtactgccaaagcaatacgggctatttagcaggttaaggtctcgttcgttatcgcaattaagcagacaaatcactccaccaactaagaacggccatgcaccaccacccacaaaatcaagaaagagctctcaatctgtcaatcctcattgtgtctggacctggtgagtttccccgtgttgcgtcaaattaagccgcaggctccacccctggtggtgcccttccgtcaatttctttaagtttcagccttgcgaccatactccccctggagcccaagcactttgatttctcgtaaggtgccgaacgcgtcaaaaatgtaacatcgtccgatccctagtcggcatagtttatggttaaaactacgacggtatctgatcgtcttcgatccccta

SEQ ID NO: 262 - DNA, 290 bp, Trichoderma reesei
catggcggcgacgttgacgggggattcggaggttgcgccggtgggggagcggccaaagtagaagccagcaccgcccagagcaagaaccatgacaccgcccagaataaaagtctcggggttgcgcttggactcggactgcagctcctgcttgctggtggtctgctgcagcttctccatgcggcggaccgtcgtggagaagaagcggcgggtgatcatggaggccattttgttttgcgctggttgtggttgaggtcgggggtcggaggtcacctgcccgggcggccgctcga

SEQ ID NO: 263 - DNA, 203 bp, Trichoderma reesei
agaattcgcccttgagcggccgcccgggcaggtttgccaccaagcccgagcgtgccagcagacagcagcgcaagcagcgcaagaaccgacaaaagaccctgcgcggcacggcaaaggtcaagggtgccaaggcgaagaaggagaaataaacgcaacgctctcaatacaatattgttggggcttgctggtggaaaaaactgtgg

SEQ ID NO: 264 - DNA, 267 bp, Trichoderma reesei
gagcggccgcccgggcaggtaccaccgaatccgctggatgcgaggaatagacatgtcgcgtgggaaatctcgctcatcgatgggggctgccacatcaatagccgcaaacaagcactcgagccacttgacaaaggtgctgagctcgatgcaggccaaaagaaactgatccgtctcagctcgcactcggataacgtagcgacgtttcttgtagtcggcggcaataccagcatctgcgtgcaagaggctgtacctcggccgcgaccacgc

SEQ ID NO: 265 - DNA, 317 bp, Trichoderma reesei
ttgccgccgggcaggtaccaatgccaggtctatatgtgcagcgcgcgcaaacgcaagggatcccatcgagaatggtatcaagggagtaaaagatagaaagacgtgataaaagagtggataatgttcgcttccggtgctgaaccgtaacgagatgtggcctccatccatttggacccgctgtcgaggcctaggcgagaggaacagcagggttcgcgatctcgtggcggaggcagcagactcgtcgtcgccgtgccgagaacattgtgtagtgacaagtaaggtgtcaatcctgcgccgtacctcggccgcgaccacgc

SEQ ID NO: 266 - DNA, 382 bp, Trichoderma reesei
gatgagggcgtcaatgtcacgacttgaaaagtcgaggaacgagtgaaggtattgaatgcgaacttcgaggttggtgtaaagatcctcgcgctggatgtgttttatcggccttgcgtttgggttcatggcgatttttggtgtgattttatgtgtatgaaaagctttcttttgttgccctcggtgaactgcgtgcagttgctggttcgatgaacaaactgcgagagctacagttgaaaggcacctattgtagggtaaggcagaggagaaacgcggaggtggtcaatgcgaggagacgcgtgaatgtgttgtttaatttggcttcttaatcgttctacgcagcttcatttaaaaggcagattgataacctcggccgcgaccacgc

SEQ ID NO: 267 - DNA, 175 bp, Trichoderma reesei
gcgtggtcgcggccgaggtactcggccatgatcttgccctgctggtcgagcttgagatacttattcagaagctcagttcgagacgttgaaactgctcggttggccatgatgggcggttgtgtgtgtggtgatgtgggaaaagagaggaagagagacctgcccgggcggccgctcg

SEQ ID NO: 268 - DNA, 276 bp, Trichoderma reesei
gcgtggtcgcggccgaggtacggaaatcggaagccctgatgagaagagagtcgaggtcaaccacgaagttaccatgtgatttgtttgatgacggagattagccctttgctttggaacatacagatgtatctttgatatctttgatcggaaataatcagttcaggcctcatgacatttagatgacgagccattgaaagagaaaataggaccccttgttttctttccaaaaaaaaaaaaaaaaaaaaaaaaaaagcttgtacctgcccgggcggccgc

SEQ ID NO: 269 - DNA, 422 bp, Trichoderma reesei
gctatgccatgattccgcaagctattaggtgcactatagatactcaagctatgcatcagctggtccgagctcgatccctagtacggccgcagtgtgctgaatcgccttcgagcggcgccggcagtagcgctcaagctcctgtcttttcatctctctcccatggaggaggatgatatgagctgggtgtgtgtggtgtgtctctcttaaccccttacttcttctcttctttacaatcaagccaaacagtttacaatcccccaaggcctttcacaatggcttcggaaagacatctggaggcaacagcgcctaccacaactacaacaatgacttcctccacgtccaggatctcaacgagcgccgccgcctggccctcgccgagatcgacaaggccccttcggctggtacctcggccgcgaccacgc

SEQ ID NO: 270 - DNA, 419 bp, Trichoderma reesei
gcgtggtcgcggccgaggtaccattgcccgctccggaaccaagcagttcatggaggccctgactgccggtgccgacgtgtccatgattggtcagtttggtgttggtttctactctgcctacctggtcgccgaccgcgtcagcgtcatctccaagcacaacgatgacgagcagtacattacgactacactcgccttcacttgtcaaacatcgtccctaccatctggcacatgcgcaatagtgccgtcatacgcgacgcttattctcttcttctcaagacttgccttgacaggattcttcgcgcggaacaggtcctcgatttcctccaagctccaatccctggtttcaacgaaaaagaagtagataacaatgcacaccaaacgcgtcccaaaagacataaaggaggggttatttccagcca

SEQ ID NO: 271 - DNA, 267 bp, Trichoderma reesei
tcgagcggccgcccgggcaggtcgccagccttggtttgcttttactgtttgcacatattttgttcacttgcttggaaaaggagaagaagattggttccggtttgaatctatctagatataaagcgcggggcacgacgtctgttttttcacggagccatgtcattttcagtgtaggatatctagcgcctgcgtgcgaatacattggttctctcttaaaaaaaaaaaaaaaaaaaaaaaaaaaagcttgtacctcggccgcgaccacgc

SEQ ID NO: 272 - DNA, 373 bp, Trichoderma reesei
gcgtggtcgcggccgaggtcggccgaggtacccagctcggatagcagtttcttgttgccgccggcatggtcccaggtggtggtgagtgttgacaatggccgtcaggttgatcttgcccgccgaaagagcattcttgagaataggcgcaacctctggcgggtttgccgggtcaataatgacggcatccttggacttgtcgtcaaccacaagataggcgtagttgttggagctcccaacccacgggggaatcgattggatatgcatcttgcgtgagttatttgtaatggaaccggcaaatctctgcgagagaaactgtctgccagacagtctcagtctattcatagatgtatggagcttgtagcctgtggtcgcc

SEQ ID NO: 273 - DNA, 308 bp, Trichoderma reesei
gagagcctggtcggccacgggagcaacgcagcaaagaggcttggagcccttgctggcacagtgagcctggaagatggcgccagtgtcgacggcgatggtaggggtcttgcagtcaacgccaatgaggtcgaggacgttggtggcacagcacagagggttggagaagaggccggtagggcagacagcagccagggcgctggtggcgaagagggcgacggcgaagaactgcatcttgaaaggtggtgatggttggtattcaacaaagaatgtttgtgtttggagagttgacctgcccgggcggccgctcg

SEQ ID NO: 274 - DNA, 570 bp, Trichoderma reesei
gataaacaaatttccacaacaaggaaaacagctttccatttacttgggctaaaacacaactctgtgctggtggacgaacatgctgttagctgggtgtcgactcgaccactagtaacggcgccagtgtgctggaattcgccttagcgtgtcgcggccgaggtacccaggttgttgacaaggtcagccttggtcataccaataccggtatcccggatggtcagggtcttggcctccttgttggggatgatgtcgatgcgcaggtccttgccagtgtcgagctggctggggtcggacagcgccttgtagcggatcttgtccaaggcatcggaggcgttggagacaagttctcgcaggaagatttccttgttggagtagacggtgttgatgatgagggagagaagctgagggatctcagcctggaactcgaaagtttcggccatggttgcgggtatcaacggaaatctgtgacttttgctaggaaagggaaaagaggggtgttgatttctcgatcacggggtattattttgttatgtgtttgtgtgaaggagacctgcccgggcggccgctcga

SEQ ID NO: 275 - DNA, 505 bp, Trichoderma reesei
atagcttccaatacaaatttatcttttttatgcaaacttatactaaatcttggtttgattactcaacctgattttacattatcactttttgttatacttagaacaaatgaaccttctgcatcagtaaaaccagttaagaaattaggatctataattaaattagtattgttttctctactatccggggagcgtcttgtagacacgagcccctctgatgatgtagaatagaattttatattattagccaatagagtagtagggattttgttccgataacttctttcgaagcccattagagtataccttaacattatattacgagatataatgcaactaccatctactctttgctcttttacaaataaattttcacttatatttgatttagatccgcgattgtccatttttctttcgatcatctcttggcttgttactatacctgagtaattacttcagccactcatatattttcatatatggcttagtacctcggccgcgaccacgc

SEQ ID NO: 276 - DNA, 450 bp, Trichoderma reesei
gcgtggtcgcggccgaggttgactggcaaccatctactgccaaatttcaagacattactcttgattccacatatgaataacccagataattacacatgagatttctcgtgggcatcactatgcacctttttcctcccgaaatcattttcgatcagtaggctggcagcgagagtattcgtttgagcctgttcctgacaccaccacttgcactttctatgctgctctggctcggacgacgcggaaccgcattgactacaccacaacccgcagcatatcgtgtcgtcgctatgcgattcgaccgatgagaacaatcatggcgtcccggatcgttcaagaccgcatcaagcttcgctttggctctctcagaagctgacggcatggtgatacgttgttatactgcgatttaggtcttcgatgagcagtagacgacctgcccgggcggccgctcga

SEQ ID NO: 277 - DNA, 408 bp, Trichoderma reesei
gcgtggtcgcggccgaggtactcggcctcatcgtggatcgctctcgagttgacctggagggcgtccattttttcccggggtttcttgcttggttgcccactctaggagttgttgtcgaggttacgctgtgcttgattccagctttatagattcagagagatgtcatcaacgatcaacaacaacagcttggttgatggagagaaagcgtcgacaggtttatccaagttgtcgatggtgaccaaaaggggatgaagaagaggacaaaatgaagttgaagaggatgggaatctgaagggaccaaaagaagcttcgtgaagtgtcttgtcaaagatgaacagagccactcacgagaaaggacgaagaagagaggtcgatccagtgaagcaaggtcttggctttttgacctgc

SEQ ID NO: 278 - DNA, 313 bp, Trichoderma reesei
gcccggggcaggtactgggccaaaggctgccgagctgcgcttcgagtgcatgatttccattgacgccctgggcatcgtctacaacagcgggccccaagtctggctcgactttgaagcggccattctcaagtggtgtgcccatgtgagggaggagataacaaacgacagaaagaaggccttttcgctcgctgacgaattcacgctgcgataatcggagtttttctttctcttctttttcttaataccttttcttcggaccaagacggcaattgctgacctggagttcttgtttccacctcggccgcgaccacgc

SEQ ID NO: 279 - DNA, 346 bp, Trichoderma reesei
gcgtggtcgcggccgaggtactcaacgaaagcgaacagtcggctggaggttgatcgcggcgcaggaatgtcgcagcgaaccagacgcccatatctatataatatcattgttagccaatcaatcgcagtgcaggcgtggaaagcgcggtggctagggtagccatttctcgggtgatttgcattgacaatttgcacatgcgaaaatcggtgcgatagagcccgtccgaacagagaacaacctcgagatggtggatgaaacgcattggccgacgcggcaggaaaaagggagaggtgggttcaggcgtcagcgggggggttaagggctgcacctgcccgggcggccgctc

SEQ ID NO: 280 - DNA, 369 bp, Trichoderma reesei
gcgtggtcgcggccgaggtacaagctttttttttttttttttttttttttttttcccctttcttctattccgttatcttaaaatgcatggctactaaggaatcgttttgtgttttcgaaagccacaatttgccaagctgacaacatcgcaataccaagcaggccgcatctccagtgaaagatgagttgaccgtatatttgaaaagggtcagaagtagatacaaaaaaaataaatcacccggggccatgtagctcccgccgccgtcatgatacgggctcaccaagaatctaccggtgcgtcaggctttcgccacggagctttacaggcactgagagtagtaagggttcaggacctggcaagttgtgccgc

SEQ ID NO: 281 - DNA, 332 bp, Trichoderma reesei
tcgagcggccgcccgggcaggtcgaaagcctgacgcaccggtagattcttggtgagcccgtatcatgacggcggcgggagctacatggccccgggtgatttattttttttgtatctacttctgacccttttcaaatatacggtcaactcatctttcactggagatgcggcctgcttggtattgcgatgttgtcagcttggcaaattgtggctttcgaaaacacaaaacgattccttagtagccatgcattttaagataacggaatagaagaaagaggaaaataaaaaaaaaaaaaaaaaaaaaaacaagcttgtacctcggccgcgaccacg

SEQ ID NO: 282 - DNA, 224 bp, Trichoderma reesei
gcgtggtcgcggccgaggtgagctacatggccccgggtgatttattttttttgtatctacttctgacccttttcaaatatacggtcaactcatctttcactggagatgcggcctgcttggtattgcgatgttgtcagcttggcaaattgtggctttcgaaaacacaaaacgattccttagtagccatgcattttaagataacggaatagaagaaagaggaaatt

SEQ ID NO: 283 - DNA, 302 bp, Trichoderma reesei
gcgtggtcgcggccgaggtacgcccacagcgagcccttgttgaagaaggggcgcatctcgatgccgacttgccagaagcggacggcgaggccgaagcagctccagaatgcaatacgatgaaccatcttgaatctcgcagaaaacttgctctcctcgaaatacctctagggaagaaactcgggtgctgagacaaattgtcgaattgtccccttgaatcgtgtcgtcggagccgcaggcggacaattggggccgttattcgagtgggagagaaagctttgggacctgcccgggcggccgctcga

SEQ ID NO: 284 - DNA, 215 bp, Trichoderma reesei
gcgtggtcgcggccgaggtacgagccgatgaaggagctgcacgacaagttccccgcccggatcgccaagaacaaggactcggttcccgccgacgatctgaagagatacatggagcaaaaggtcattgtagaggagattgtggccaagtttaacgagcccacctactcggactttaacgcggccgatagggagtacctgcccgggcggccgctcga

SEQ ID NO: 285 - DNA, 373 bp, Trichoderma reesei
cgagcggccgcccgggcaggtactggggcacccttattccctgccttaaggagatgggcaaggactttctcaaattcatggtgctcgtcgtcattgtctacctcggcttcctcaccacgttttccctcgttggccgggacatctttagccttggcaagatgacaggcatcttgaccaagattttttacggctcgagctatgttggcttcgaggtcatggaccagattgaccccgtctttggccctcctctgatgatcatcttcatcaccttgtcttcgttcctcctcatgggctcgctcaccggtatgctgtccaacagcttttcgcgcgtcatcacccacgccaaggaggagtacctcggccgcgaccacgc

SEQ ID NO: 286 - DNA, 406 bp, Trichoderma reesei
taaagcaactcttctttgtcgactcgaatcgaacgaggaaaactgacttgctgctgctgctgctgctcggtgttgttcaatgctccctgtttcacgaaccggtttatgatttacgacccccacgaccgatgacggaaagatctggactacccacacatctccacaaagaccaaagcagatgaggtctgctttgcgatcgcgtggaggataatttccttgcctgttttcttttatggacttcttttgagatacctggacctttaaccctccgatgcggtgcattttatggggtttcctttgtcttgttttcttacatttttcatagtctgactaattgacattgtcaccatcaaaaaaaaaaaaaaaaaaggaaaccccataaaatgcacctcggccgcgaccacgc

SEQ ID NO: 287 - DNA, 488 bp, Trichoderma reesei
gagcggccgcccgggcaggtacagtaatacatatccttcgccggcaaagcaacgtcacggcgggcatgtatcataactttggccacagatggagtgccatcatgtccagtctttggatgtcaaatcccactttccatcctccccgaaaaaaatggaaaagaaaaataagaggtttcgagactataaagtaatacgcatcattcatgcatagtgggatgcatcaagacaggtccaggatagagcaggactgatggcacgtctctgggcgcgagacagcttgtctcgtgtagacggagtgaacactctcggcggagtccgtcttggagaggtcgttaccgttctcctcatcaacgggtccgtggacggactcttcgaagagaggatcaggctcgttcacctcaaacttggcttgaagtcggaaaggttgtggtgggaaaagctgttggagcggcgacgggcattggtgaagcggaaatcttcatccacga

SEQ ID NO: 288 - DNA, 329 bp, Trichoderma reesei
gcgtggtcgcggccgaggtacccgccgctcgaccacgagtgcttccgcaccctgttccaccgcccttacttccacgtccagatggtctctgacgtcgccggcgtgtcgctgggcggcgcgctgaagaacattgtggccctggctgccggtttcgtggacggtcgtggctggggcgacaatgccaaggctgccgtgatgcgaattggcctcatggaaatggtcaagtttggcaaggagttctttggcgagacggtgcgcaccggcacctttaccgagtcgtcggccggtgtcgccgatctcatcacgtcgtgcccgggcggccgctcgaa

SEQ ID NO: 289 - DNA, 423 bp, Trichoderma reesei
gcgtggtcgcggccgaggtacaagctttttttttttttttttttttttttttttttcaaggacaagaagcaaacatgggaagagacttcttgatataatgaatgatgcctatccatgatgataacgtataaacaaaagcccaaaccatagacatactccgtctaaacaatgccaagcatcaatcatcccttcctccctccctcttcttcaagcaagtcaaagccgagacagagagggagaaaaagaaaatcaaaagcaagaggaaggaataaaacaaaggccaaaaaagcgtatacatctatatttctcatcatcagcgccgtaacctctgcttttccgcctcatcaccatcatcatcgctctcatcatcatcctcctccccaacgacataacgcccggggacctgcccgggcggccgctcga

SEQ ID NO: 290 - DNA, 248 bp, Trichoderma reesei
gccttgggccgcccgggcaggtacctttgatgtgtctctcctgtccattgacaatggcgtcttcgaggtcttggctaccgccggtgacacccaccttggtggtgaggactttgaccagcgcattatcaactacctggccaaggcctacaacaagaagaacaacgtcgacatctccaaggacctcaaggccatgggcaagctcaagcgtgaagccgaaaaggccaagcgtacctcggccgcgaccacgc

SEQ ID NO: 291 - DNA, 304 bp, Trichoderma reesei
gttctcaaacctcattatgatagacaaaaaacggactgcgtattcgcatagtcgacccgatgataataatacatgctaatgaaccgagtgtctgtgttgctctcatgccaccgccctacctaatcatttacatacgtctcttggcattagggttgttgggcagcttccaattgttcacgccataccaccacctcctcaggcggacgcctactgaatcgccatgtaatctggcgttcttgttccaatggtgccacccaaccagtgccaagttcagcagaacgccacctgcccgggcggccgctcc

SEQ ID NO: 292 - DNA, 573 bp, Trichoderma reesei
agaacgtccagtagtgcgtcatgcatttgctgtagtatgtccaggaaaccaatagatgaggtttgttgggatttttccccaagaccccgaaaggatggtttgttggttagacctggggatgagacaatcccagttggcgaagggcttcgagagggtctcttagattccccaggatcgcaaggggagcttttgcccgggtaagccatacttgagtctatcgatatcgactagtatagacggaattactgtggcctctgtcatgagagcattgaatgatttgcttggacatattggaaaggacagtcctccatgaaggtaaggcaagaaacgtgggatgtttgttgcgaatcgaatggatgataatggcggggcgaaggccaataaatatcctgtgggatggcccgctcgaataggcttctggactatgcagctgaatcagatcgcttaaaccagcggcatgagccgcgctgctggagacggcagtcggcaggataagctccgagatcatgaggcacataatggccacggccaagacatccgagtctgcagtacctgcccgggcggccgctcgat

SEQ ID NO: 293 - DNA, 369 bp, Trichoderma reesei
cgagcggccgcccgggcaggtgtacaagctttttttttttttttttttttttttttttgataggagacgatattttctctctcaattctgatacacttcctcttattcctttggtcgttcctttctataccaaacagttccatgtcgctcacggttgacagctcacagctcgtccttctggtcctcgttctccttgggggtaaatttgcgcaggacgttgatcttgatctggatctcatcccgcttagaaggggcaaggccacccttggccaggatgccctgcagtctcgcaagctccttgttaacaaacttctcattcttgctcagcttgtcgaagacgcggacgtagtacctcggccgcgaccacgc

SEQ ID NO: 294 - DNA, 161 bp, Trichoderma reesei
gcgtggtcgcggccgaggtaccaccaccgagatcgtagacaatgatctggcgctcaccgtcggtcttgtccagaccataggcgatagcggcagcggtgggttcgttgacgattcggagaacgttcaagccggcaatggtacctgcccgggcggccgctcga

SEQ ID NO: 295 - DNA, 570 bp, Trichoderma reesei
tcgagcggccgcccgggcaggtgcggtgctcctgcgacgtttggacaggccatgtaagcctgtgaacaagagggaaaggaaaaaaaaaaaaatcgatgaaaaaagaaaaagaaaagaaagcagggttacccctgaaagattgatgaagatgaagatgacacacaccctacttttttattattctctactttcttttgttctacaagttgcaacgaaagcgatattccacccacggagacgacagagacggaaatatattcccttgtcaagattgaattggaagaaaaggagaagcgaggaaggagtgcgtgttccgttgaaaaccatataccacctttttgcggcgttacaacgtgtgtgatattttcgggaggtggaagggcaggcgggcacattgatttgtatcatggacatttgagtgtcttgttattttggaaagagttttatcggaactggattcgacgagagaactgagtgtatataccatatcttcttttattctcccctacaatgtaggatttaccattattttccttttataataatacagtacctcggccgcgaccacgc

SEQ ID NO: 296 - DNA, 340 bp, Trichoderma reesei
tctccctgttctggctcgcccgttcttgcgtttgtcgccctttggcgggctcgtctttgagctcctgtcgcgcttcttcggcgtctaaaattcgaatcgatatcaccacctactccatgtcgatttgaaacccagacagaacgacagggatccaaccagaaaacacatttggcgacgggagaaggaaacaaccgaggaaggaatatcgaacgcatacaaggagggcggacggctctgacatggtcaagggcagaaggcgaagatactgttgagagtgagataccgtcgacgagccgacactggcgcttcgctttgcgtgccctgcccgggcggccgctca

SEQ ID NO: 297 - DNA, 422 bp, Trichoderma reesei
gcgtggtcgcggccgaggtacaatgcaaagaagaaaaaaaacctgatatcttggtgaaaacaacctccctcccccgagtgttattcttctcttcctctctagtttgtgcttgagcgaccgccctggccaacgttggggccctccttgatgccctggctctgtcctccgctcgcgttcatgccgggaatgcccttgccgtgctcctgcaggccctcgggcagggggcggccttgtcttttgacttatcttcattggtgacgccgtggccaatgttgtggtcagcctcggggaaggggccgttgtcgcttgatccgtctccgttgcgaggcatcttgaattatgtgtgaagttgtttgtgttggtggtgatggttttgattttggttgatgttgatgttgttacctgcccgggcggccgctcga

SEQ ID NO: 298 - DNA, 235 bp, Trichoderma reesei
gcgtggtcgcggccgaggtactgtagaaatagataggaataataaaaaggcagaatgttgtctcgaaggatggatggcaggcaaatgaatgccttgcattcagtcgtcattcccccccagccctgaagagatgacatcatccagaccaaccccccgcgaaaagtggcttgagcaatagccctggatctggaccaaatagaggcgcgtcacgagccacatccaagacgaaagaggc

SEQ ID NO: 299 - DNA, 452 bp, Trichoderma reesei
gcgtggtcgcggccgaggtaccatgtcacgctcatcgttcatgaagccgcagtcaaaatctgggctctcgtatggatcagcgctcttgatatgagtgctgcctctggagaaaggatattccaagaaatggaacatggtgaaaaattttccgggtggcatcaacatatggtcaccaaaccagcctgatatgacgctgtagtgcatcaccggcttgtctggcttgtccttgaaatagctcttccagccatccttgaagtgaggagtcggccagctctcgaactccttcaactcctgctctgtagggcggatcttgacgcctgcctcgatgccgttggtggaaagagggccggttcccttcaaatgccactcatcgaacacgcgcctttgcacttcgggttcgccccggataaagtcatcgaaagtttcgaacctgcccgggcggccgctcgaaa

SEQ ID NO: 300 - DNA, 168 bp, Trichoderma reesei
tgagcggccgcccgggcaggtacaggtcgtgctcattacagccatcggctacttcaccaaatggatcactttatcaagacctgtttccgcatggattgcgcttctcccactcactgccgcgcgactcgtcggcatcctggcaaagacgtacctcggccgcgaccacgc

SEQ ID NO: 301 - DNA, 322 bp, Trichoderma reesei
gcgtggtcgcggccgaggtctcgctcggccttgatgcgcataatctcgtcacgcaaagccatcctctccttctgcacatgtcgaactcgcttgcgcagcgaatgccagtggttcaagtgaatagcctagtgaatcacgttagtatcccctttacccaatgcagatacgctgttgccccaagacatacgtgctgaaggaaacgagacttgagctcctcccggtggagcccagcccggttgacaccgccctggacagccttgtatgtctcaaggctggcatttgagagcacgacaatgagccgctgacctgcccgggcggccgc

SEQ ID NO: 302 - DNA, 321 bp, Trichoderma reesei
gcgtggtcgcggccgaggtactcgggaattccaggcgaatagataagcgactcgacaaagactggttggctaagcgaagcaatatcgttggctgttgcagcggaaagcaaaatgggctcgacttggtcatcttgactgtttgttggcacttcttcttcttcaagctcttctggtaaatcaggtagtgttggcctaacatgctcctctgcatatctcatccgttcctccaatgtgacgggtatttgctgtggaattatcagacgattatctcttgcctgcgcatccaggatttcagcagcccgcggacctgcccgggcggcc

SEQ ID NO: 303 - DNA, 298 bp, Trichoderma reesei
cgagcggccgcccgggcaggtacataaatgggccgttcgtgtcatcaggccaaatgcatcatcatcccgtccaaataatatgaccatgctcgacgccgcttttggttttatatcctccggctccctccaactggggccgctccatcgttccacatcaatcgaggtatcaagttcccacaagagatctgctgctgatctctttccgtctgtttcccatttctccatctctagatccatgttactgcatctaggcagaaggcttgcggccgaccatcaggtacctcggccgcgaccacgc

SEQ ID NO: 304 - DNA, 407 bp, Trichoderma reesei
cggccgcccgggcaggtacaagctttttttttttttttttttttttttcagtttcccttttttgtttcattgcctatcgaccggtgtctatgaccaaagatcgagcgtcgacgttcatttttcgtcaactcgtagtgtatgcacgcaaacaatgtcccccatacaccagaccgaaaaagcaaagccgaatcctccaccgttttaccaagaaaacacctttaaacctcagcaatctccctcaatcgtcgcagagttgatcgcatggcagcggcagcgggtgtggcaacagtgtaggcaccgccagcaatggttcggttgcaggcacggcagttccagataccgacagactttcttcggacggtggtctttccgcagaaaaagcaggtgtacctcggccgcgaccacgc

SEQ ID NO: 305 - DNA, 321 bp, Trichoderma reesei
gcgtggtcgcggccgaggtacgggcctctcctgacagctcctccagcgtcagccccttagtctccggaaccaacagcgagaccagcgtgcccagtaacatgaagagggcaaagagccgcagcaggccgggaggcgtcttgccgtccgtcttggcctgtgaaaaggtgctgttggcgccctgcttctcgtagtttgcgatggttttggagtcgagcgtgcggatctcgaagacgtagagagggatgcctcgacggtctcggcggccggtccattggggatacaatcgccggctctgctcgtacctgcccgggcggccgctcg

SEQ ID NO: 306 - DNA, 453 bp, Trichoderma reesei
gaaaagatccccaacgccgtttctcagcgatcttgttctatctggatggtcgaaaccgagatagtcgtcttcagatgaggctatgttccataactcgtcgtcatcattgagatattgtggtttcgagtagtttgccctccttgcaatggcaaacttgatcttttcaaagctcttgcccttaatacctgtcctcttctcgagcctcttctttgtgtcggcaaatttctcgccctccaggagaaggaatttgaacggaaccccgtgaactctgttgacttcattctggaagtggaagacgtggatgaagttgttctcatcggccgccttctcctcttctggaattcgttcggcaaagatctgggtatactcgttgaggttcacgacaggctgatcgcgagctggctcccgataaaatctgttagaactcgtttcgtacctcggccgcgaccacgc

SEQ ID NO: 307 - DNA, 193 bp, Trichoderma reesei
gcggccgcccgggcaggtgagaacaagaagagcgcgaggaagaaactcgatgagtagtgcagagggcaagactatcgttctctgtccctgtgctctcctctggctctgttctgctctggcttgccctactgactgcgctttccttgcaggcagaggcgcgaagaaacggtatcgacctcggccgcgaccacgc

SEQ ID NO: 308 - DNA, 411 bp, Trichoderma reesei
ggagcggccgcccgggcaggtctgctgagcgctctaggccagctgtccggatttctacccactggacgagatacttgttctcctcttgtggaagacctggggtctagagaaggggcttgcttcagctcgcaggttttctggagctttaaacaggtcgcctgtctgcgaagctttctcctttgagtgtgttctgcctcatctcttgccatcgccccgttcgcgtctttggagacgggttgttgctatcgcgctcttggccagctgcccagctctctatccactggatgggatttcctccccttctttggaagactggggccttgggaagggaattgcctgagctcgcaggttcttctggagctcattgcaagtcgcctgtctgcgtaactcgccttatccactgcgtgtcat

SEQ ID NO: 309 - DNA, 167 bp, Trichoderma reesei
cgagcggccgcccgggcaggtacgggacgatgggaagtgtcgtgaccgtgtatacttttttcacataggccgcaatcgacgtttgccgtcatatgagcagggaacatcaagcttttgtttctttcttttttttttcccgcaaaaaaaaacctcggccgcgaccacgc

SEQ ID NO: 310 - DNA, 158 bp, Trichoderma reesei
gcgtggtcgcggccgaggtccgcgacgccgtcacctacaccgagcacgccaagcgcaagaccgtcacctcgctcgacgttgtactacgcccttaagcgacagggccgcatccctctacggtttcggtgattaaagtacctgcccgggcggccgctcga

SEQ ID NO: 311 - DNA, 248 bp, Trichoderma reesei
aggcccgttgggaaagtctgcctcaatatcaaagtcgaagccatcgacagaggtgggggggcccgtagtgatgtcgtcaaaggggcgagggcccgtgtagctcgcattgtaaggaccaaaagcattgtaaaggaatgtagcaaagtcggttgctgttccgttgtctcccacgaagtagttggaagtcagagcgttgtatacgcctccgatactcagaataaccttgacctgcccggggcggccgctcg

SEQ ID NO: 312 - DNA, 427 bp, Trichoderma reesei
cagagtcttatccgggcaaccttggcttgccctcgaagctcttgagccattgcatgtccctccagtcagacattccttactgcaggtccaaaggtgtcaaggttattctgagtatcggaggcgtatacaacgctctgacttccaactacttcgtgggagacaacggaacagcaaccgactttgctacattcctttacaatgcttttggtccttacaatgcgagctacacgggccctcgcccctttgacgacatcactacgggcctccccacctctgtcgatggcttcgactttgatattgaggcagactttcccaacgggccttacatcaagatgattgagacgttccgctctctcgactcctccatgctgataaccggtgctcctcagtgccctactaatcctcagtacctcggccgcgaccacgc

SEQ ID NO: 313 - DNA, 601 bp, Trichoderma reesei
gcgtggtcgcggccgaggtaccgacgaagtccaacaagctataataaggaaggtccgacgggatcgctatggctgggagaagtcatgtgctgatatagctggagagatgacatcagaaggccacccggtatcagctatgacagtgtggagggtccttaaaggtgccggttatcgcaagactaagccaataaggaagcccggtctgacggccgagatgaaaaaagaccggctttagtggtgcttagaccaccggcactggaccctagaagactggaaaaaggtaatgcagctgtattcgggaacggtggaagggggcgtctgagttcatgttctggagcagctttacgtataatcgtaaagggccctgtcactgttggaagccagagacagcaaaggagaggaaggctgctgagaaagacctggaacggttgaatcgggagctggaacctgttatgagagaacagtggcatctaacaacaaggatgcggcgtttgaacgttcgacctaaccgacttccgggcccgcagccagtgtggaagtggacagagaagacaggcaagcttacccgatcaaagaagggagacctcggccgcgaccacgc

SEQ ID NO: 314 - DNA, 137 bp, Trichoderma reesei
tgccattggaagtattccggttggtggaggcacgttaccggctgattccttgttgtattgcccctcgacggggtcgtcacctggggtagccatgctgtagaggctgcttccggccttgtatcaatgtagttgttgga

SEQ ID NO: 315 - DNA, 386 bp, Trichoderma reesei
gcgtggtcgcggccgaggtacccgcttccagtgccgtggacgacgacgacctagactacctacaataacgacaaaacatacatacaaatagttaaagaagacagacatgagtaaaaagatcctttatatcgcgatcccttatcataaagctttttttcggacatacaaagcacgcaatgtcgcatgctctgttctcaagttccacatccattatgtccttcccccccgttttcactcgatgcctactttccgccccttgtgctctctcaccttctccgtcttcctacccctatcaatcgattcatacagattcttcttcctttcttcctctcatagccattgaggttgtgaaaaaaaggttcagacctgcccgggcggccgctcga

SEQ ID NO: 316 - DNA, 682 bp, Trichoderma reesei
gcgtggtcgcggccgaggtacccgcttccagtgccgtggacgacgacgacctagactacctacaataacgacaaaacatacatacaaatagttaaagaagacagacatgagtaaaaagatcctttatatcgcgatcccttatcataaagctttttttcggacatacaaagcacgcaatgtcgcatgctctgttctcaagttccacatccattatgtccttcccccccgttttcactcgatgcctactttccgccccttgtgctctctcaccttctccgtcttcctacccctatcaatcgattcatacagattcttcttcctttcttcctctcatagccattgaggttgtgaaaaaaaggttcagtgcctggtcattcattatatgaaaataggtgtttagttgaagaggtgtgggtttacatgagaagaatcgaaacccggctgacttgatcctgggattgcatatgctgattacaagtatatcaagaagtagctctctcgaggcaagcttggagctcttcgggcatgatgccctgattgctcaaataccggcacatgctcttgaccaactcgacctgctcctcgggatccaggcttgtgatggccgtctccaggacgctgcccagcgtgaccttgtgcacctcgatgaaggtgtggaagtacctgcccgggcggccgctca

SEQ ID NO: 317 - DNA, 360 bp, Trichoderma reesei
tcaagcccagcacgacaaggagaagcaggaggcgccgaatgccattgctcccctgaccttgggtggcccccttattgacggcaacaccaccgcttctggcactaatggcaaggccctgtaaagcaaacttccgctcggaggacgacacgaccacgggacgaagaggaagggaaaacacaaagggtggaagagaaatcatccaaatgagaaagatgggggggcaaaaacaataagacgtaaagagaaacgaaacaatcttggcaagtgtcttttgtcattgggcggcgtttggctgaatgtatccacggttctttcttatctgttccatcatcaaatgctgtacctcggccgcgaccacgc

SEQ ID NO: 318 - DNA, 129 bp, Trichoderma reesei
cgagcggccgcccgggcaggtacacctgcctcgacgagctgctgcggaatcaagaaccggggtcgataggccaggtcctcatcgatgacgccgacagcacgtatctggcatggaatctcgccgccgtca

SEQ ID NO: 319 - DNA, 279 bp, Trichoderma reesei
gcgtggtcgcggccgaggtactcccgcccagagatcgagcgtgttgcgcgattgggtggatacctcgcccgcggtagaggagaaacgactgttacctcgctggacaaggcgaatgtgctagcgacaggcaggctctggcgaaaggttatggatgaggtgttccaagctgaattcccagatctcaaggtcaagcaccagcttatcgacagtgcggccatgatcatggtcaagagcccgacgcagcttaacggcgttgtacctgcccgggcggccgctcga

SEQ ID NO: 320 - DNA, 194 bp, Trichoderma reesei
tccattttcccaacatactccagattatgtcgacatcaggtcgtaagcgcgggaccggtcgtcgtggctcccttggacaccgcccctggcattcataaataggtagttccttgacgggcgctctccatgtctgtataaaatagttgctggttatcgcaccgaggctgttcttcgaaacctgcccgggcggccgc

SEQ ID NO: 321 - DNA, 251 bp, Trichoderma reesei
tcgagcggccgcccgggcaggtactccctgaaccgatccgtcttctcccactcgagattatacaccacgttccagcacgtcagcaacagcatcgggaacttgaccgtccaataagcaagatacccatcaggcagtgatcccacgctgcgcttcagcgagtccgacatgtcttcgtagtgattccgcttgttgcgaagagcgcgcaacaggtcgagcagcttgttcccggtgtacctcggccgcgaccacgc

SEQ ID NO: 322 - DNA, 224 bp, Trichoderma reesei
gagcggccgcccgggcaggtcgaggagaagggtggccgccgcatcacccagtccggccagcgtgacttggaccgaattgcccagaccaccgctgaggccgaggaggaggaggatgacgagtaaatcaaaataaactaaaagtttgctttatttttcttgtctttctcttcacaatgtcatgggatggcggcatcggaatgggcgtacctcggccgcgaccacgc

SEQ ID NO: 323 - DNA, 174 bp, Trichoderma reesei
gagcggccgcccgggcaggtacagcccctgaaacactcttcttgtctgagcgtgcctcttgatatctttatcggggaacatggtccaggcatcgggactgggatgcttccacgcatcataccaacctgattttggcagcttggagccaattccgtacctcggccgcgaccacgc

SEQ ID NO: 324 - DNA, 294 bp, Trichoderma reesei
gcgtggtcgcggccgaggtactcgtttcagggaatggacctcgaatcggaaactcttctggctgccaacctgcccaacggtcagctattgcaaataacccctcgagttgtcactctcctggatcccgaaagcggggcttcattgtgctcatggcaatcgccggatggtaaggtcatcacggcggcgtctgccaatacgaagtgggctttgttgtcaatagatgggtcgttgttggtctcgctgaaccttctcgacggcctcaaagcagaagtacctgcccgggcggccgctcga

SEQ ID NO: 325 - DNA, 325 bp, Trichoderma reesei
gcgtggtcgcggccgaggtaccaagcgaggtgaataacccgaaaagaagaacagcaaagagaaacgaattcgcaattggagtcaatgtcccaagagtctttgcacaaggaaaagccgccaagcaagaggaaccaaaagtagcagaacggagaacgggaggggggaagggtgagaattgtgtcgtatatagtcggaggcagcctctcagtctcgatcaagcagtggtctgttatcccaaggctcgtcaatggcgctagtctcgtcctcggcgggagttgttgtttgcgtttcgccttccgtcctgtacctgcccgggcggccgctc

SEQ ID NO: 326 - DNA, 471 bp, Trichoderma reesei
ttcgagcggccgcccgggcaggtacaagcccgggttgttgaaaagaaacctcaagtagcaaagacattgctatactttgaactccagtccttttccatccctttcctctccctccctttttttgtttgcgtttttttgttttcggtttccattcggcggcacaaccacccttccctctccaatccaaaatttgacgaaagggccaccaggccacaggatgcatccccatcgcgcgattctccggacaaatattttaatatacacaaggagagtggaaatgcatatgcgaagaatgcaaaagttgcattcaggacacaagagtatttccattccctccaaagacttgagagagagagccaccggtcgtttgcccctttatcccccgtctgggataatcccctagggcttcacagtccattgaaaagggaagggaacttgtccataaatcctttacctcggccgcgaccacgc

SEQ ID NO: 327 - DNA, 166 bp, Trichoderma reesei
atccccaaaagctaccacacacatggagacacgtattcctgttacattgaagagacgaaagaaatctcattgcccaaactgaagaagaaaaaaacagcaaagatcccctgctggacatggccgcctcatgaaacaacgccagagtacctgcccgggcggccgctcg

SEQ ID NO: 328 - DNA, 431 bp, Trichoderma reesei
gcgactatccccttattctggtgctttacttgatccccaaattttgtttataccatcgttttttgtttctttttcccccatggaggatttttgggattttggatatcatcacaagcgacgaatagcatggcaacggtgctcgttttcatcccccgcgagagggttcagtggattatcgttattgggcatcactgggttttggcgtgcggaatcttacgggacgagagcttttttctctcgacatccccttatcgtgtatagcatttgctcgtttatcgaggcggattcgttctctcattttatgaaaaagtcggccttcctctgatgtataacctggagatgaaaatatttgattcgaataccacctgcagtatgtatgatcaaaaaaaaaaaaaaaaaaaaaaagcttgtacctgcccgggcggccgctc

SEQ ID NO: 329 - DNA, 257 bp, Trichoderma reesei
gcgtggtcgcggccgaggtacagatggcgacaagaaaaaaaaagaaagaaaaaagaaaagaaaacaagacgatgcggacgttctggcaagagaaggagaaaagaggcccgagctgggaaaagatgctgctctcgtccgtcgtgtggccctggtccgtcaaattcccctcagctgcagagaaggtgcaaggtggaaattggcgatagtagtagcgacaaggacggagacgatgcgccagtacctgcccgggcggccgc

SEQ ID NO: 330 - DNA, 197 bp, Trichoderma reesei
ctccccacgacaattggcccccgaacgaaatgaactaagacgtctcgacgaagcaatgcccagatggaggggaagatatcaagatgatggtttgcattgtgggtagagctgttgagaagggtgtattacaacatgttcattactcgacgatgccgattccatctctttccgggtcggtacctcggccgcgaccacgc

SEQ ID NO: 331 - DNA, 436 bp, Trichoderma reesei
gcgtggtcgcggccgaggtgatgagggctcgctccaaataaacgactcgctcttctacctgacttgacgcatctttcacatttccaatgagttcacgatgatacgacaagcttagctgctgcaccagcacggatacctctccgtgacgattgcgaccattcaattggaatcagcataccggtgcgcatcggcaattccagctatgggagtcttggacgaacgcgaaagatgggaactggacaacttcagtcgggcaaagacatcgtttaaaggatgtaaagccatggaggaacagctgcaacatgaggcacgcggaggaaccagatacgctgcttgacaagctataaaatgcagaatctacttcatttccaactttaaaaaaaaaaaaaggggctcggaaaaagtgaagcttgtacctgcccgggcggccgctcga

SEQ ID NO: 332 - DNA, 387 bp, Trichoderma reesei
gcgtggtcgcggccgaggtacgaccgcaaggtgaacgagatgcaagcgtccctgacccttttgggcctcaagcagagccggtccgagaacattgaccagctcacggctgcccttctgtctgctgccgacgacaacgtcctggctctcatggcaagaggtgatgcggacaacattgcctctggaaatctggttcaaaatgacagaatgagtctccgtgccatgctcgctcaaatggacgccatgggtgacaggattcgccacctgctcggcgatgaagccccgccggcagcctcaatgcccaaggctgctgatacgggctcaccggccgttaccgatacttccggcgtggacacgtttcttcccgaaaaggcggaaccctctgcaccc

SEQ ID NO: 333 - DNA, 587 bp, Trichoderma reesei
tgagcggccgcccgggcaggtaccgcttgggatcagtggcaccgcagggttgtcctcggcgcagttagaggcacaagtgttgtctcctccgcagttgtttcggcactgaacgacgtattcttggcagatgaagaatggcagcgtcagggtgtattcggagatgttgggctgcttgttgtcaccgcagagacagccatagctcaatgttttaggattacactcgttgaccagcgtcttcttgttggtggtctgctggcagatgatggggcacgtcgacgtctccgagttgcaccagttctgtcttgtcgacaaaggaacactgtcgggatcgatgtagtagtccttagctatcgagacggcaaccatggtggcggtgaccagaagtgacttgagggacaccatcttgactgttgtatgtgataatatgtcgagggagaagacgcgcttcgtgatgagggggtagaccaatgatgctgtgagagacagattatgtaaaaacgaccggcaggcgcaggagagtgaattgcggatccagaagcgagagaccgggggagggagaaggagcacctgcccgggcggccgctcga

SEQ ID NO: 334 - DNA, 439 bp, Trichoderma reesei
caccgcaaggttgtcctcggcgcagttagaggcacaagtgttgtctcctccgcagttgtttcggcactgaacgacgtattcttggcagatgaagaatggcagcgtcagggtgtattcggagatgttgggctgcttgttgtcaccgcagagacagccatagctcaatgttttaggattacactcgttgaccagcgtcttcttgttggtggtctgctggcagatgatggggcacgtcgacgtctccgagttgcaccagttctgtcttgtcgacaaaggaacactgtcgggatcgatgtagtagtccttagctatcgagacggcaaccatggtggcggtgaccagaagtgacttgagggacaccatcttgactgttgtatgtgataatatgtcgagggagaagacgcgcttcgtgatgagacctgcccgggcggccgctcga

SEQ ID NO: 335 - DNA, 226 bp, Trichoderma reesei
tcgagcggccgcccgggcaggtaccagtcattgacaaaactgcactgggcgccagcaacgcaacatgtggtgccggaccaccctatgcctccacattggccaaataatgctgcgcaattctgctgaatagagagtgatacaaggcttgctagagccacgaggataagcttaccagccatcccgtctaacagttcgggaagggcaactacctcggccgcgaccacgc

SEQ ID NO: 336 - DNA, 226 bp, Trichoderma reesei
tcgagcggccgcccgggcaggtgcagaactatcctcagtgcgtgaacatcgccgtcacaggctcgggcacgaaagcgctccctgccggaactcctgcaactcagctctacaagcccactgaccctggcatcttgttcaacccttacacaacaatcacgagctacaccatccctggcccagccctgtggcaaggctagatccaggggtacctcggccgcgaccacgc

SEQ ID NO: 337 - DNA, 590 bp, Trichoderma reesei
cccgggcaggtacaatcaatttttatgaaagcgtcggctgcttcaatacaaactcaaacacaaggtaaaagcaatcttccctctttgaaacctcgcaatcaatacatgtccctccagttgcagcctctcgtcgtttcgagatgctaaccagcgacgccgacgccaacattgtcttcccctgtccctccttgccccgcaagtcatgcttcattcctcagaccctgtccgcctacatcaaccaccacagacgctgctagttatacacgagttgaaaactaaacctcacggcatcattgcgtatctcttccactgctatcatagttgatgaatgagtcgtcaagaccgcgccgctgcgatcccccagaatcttcacacacatcgacatgatcgtggatgtgcccataagatcccccaccccctgctaacgtcgaacgaagtgtccatttcatgacaacaagcctttgccttcctttggttgttcgttcccgtccccgtcaatgtcaagtgcagtgcataaagtatgcgactgcttcgtaagagaatatctgtgtaagaagtctcaaatcgtacctgcccgggcggccgctcga

SEQ ID NO: 338 - DNA, 294 bp, Trichoderma reesei
gcgtggtcgcggccgaggtcgaaacgccctcatccgccttgatcgcgacagctacgaggtgtcggctcgcctttgggcttttgcccaatacttccgctttgcccggcccggatctgtccgcattggtgcaacaagcgacgtcgagaacgtctatgtgaccgcatatgtcaacaagaatggaaccgttgctattcccgtcatcaacgccgctcactttccttacgaccttacaatcgatctggagggtatcaagaagaggaagctgagcgagtacctgcccgggcggccgctcga

SEQ ID NO: 339 - DNA, 357 bp, Trichoderma reesei
ccatctgggcggcccaaatctcgagacagtctcgagcttgccatcccaagcttgacgttcgcagcgcggatcatgcgcggctcgaggcgcaaggtagaccggacgtcgtggtggacggcggcggaggagtcgtagcgcatgacgaagtagtggccgtgggtgtgcttcatctggtggatggagacgggtttggggagggagaagacaccccagttggagaggccgcggatgacgccgccgttgcggaggacgagggatcctactgtctgggcgatttcttttactcggtgaggttgcccggccggacaatggctattaattcgtagagcatcgttgcgacctcggccgcgaccacgc

SEQ ID NO: 340 - DNA, 563 bp, Trichoderma reesei
gcgtggtcgcggccgaggtacgactgtttaattaaaacacagcactttgctgaaagattaaaaatctaagtataaagtgtgatatctgcccggtgccggctggttaacagatataattgaatatattaatgtttgatgtagacggaaaccccggttaaaggcggtcttaacgtgagggtcctaaggtagcgaaatgccttggccgttaaatgcggtcttgcatgaatggtgtaacgatacaacagctgtctctatgattgactcagtgaaattggaatagctgtgcagatacagcttacctctagttagacgagaagaccctatgcagctttactgtcactaattatagagtatgataaacgattttcagaatataaggtaattgacaaatatgacaatgagaaacctttattcttttttcatatgaatgaattggtttaggactatgagtaattaattaattttatggtcacataaaattatatagctcattttagtagatcaacctaattcaacttatttatttttaaaataagtaagtacctgcccgggcggccgctcga

SEQ ID NO: 341 - DNA, 245 bp, Trichoderma reesei
gcgtggtcgcggccgaggtacgactatgcgggatcatgtgaccagacgagtggccaccaggcgaatctccatccctcttacgataaccctgcgtctacgccgttctctaccgacgcagccattgactactacaccaggagcggagtggctcccagcaagattgtgctcggcatgcccatctacggccgcgctttcgaaaatacggatggcccgggcaagccgtacctgcccggcggcccgctcga

SEQ ID NO: 342 - DNA, 416 bp, Trichoderma reesei
tcgagcggccgcccgggcaggtgttgctttctagaggaacctctttccgcataagcgtgatacccgggaggagttgcttgcgcgggtgctggcgaatatgaggactccgaggacctaaagatcgttggcttaatggatggaccttttttttttcttcttttcttttttttttcttttgtctcttggcttgcttataatctctactactcacgactgcggtgcttggacgacttgataatgacagttttgctcagcaacagttgggttcaatgaatttccgctagcagttttcagcaacatgacgcgtgcttctaggtatatcaaaggagcccttcaatgaaaatgcaaagacccgtccttgaaccaaaaaaaaaaaaaaaaaaaaaaaaaagcttgtacctcggccgcgaccacgc

SEQ ID NO: 343 - DNA, 719 bp, Trichoderma reesei
gagggaggagtgtgaattgtatattccggcgaccggtgcaccaagtgccgggccccattacagcctccctagagttcctataatacaagttttctttttcttcattacacagacaagcatgcaagcggagagttcatcatctcatcccccagttcacaccaaggtcccctgcctgatcacctcatttcttatccgaatcctcaaacacgttcaagcccaggccctcggcatccagcatcagcctgttcttggctccagactcctgcagctgctgggcaatgagcctggcgttctcaatcttcttcagctcccacgtagggccttgctttttctttgaagggcgttcgccaattcaagcttcgggggattcgggcctccaccctgcgccttgacgaaccaaggcctggtttttcctggcgggccttgttcgacgaagaaaagccgctcggtgaaccttcttggttggggcggacctggtttgggctttcggcaaggcaaggctgggaaacttctgggcgaaaaaagggcgaagggtggcggtcaaggagaataacaatcggtcaaagggagaaatggtggaacccgcggttgcttctggggggaccaggttttcttggtaccttgggcccgcgacccacgctaaagggggaaattctgcaggatatcccatcacactgggcggccgctcgatgcatgcatctagaggggcccaattcgcc

SEQ ID NO: 344 - DNA, 168 bp, Trichoderma reesei
gcgtggtcgcggccgaggtactccttcggtccaatgatccacgcaatacgccatccgggcagtcggaagcgcttggtaaggccatcgataatcaggacatcgtcctcgtcaacatcctcgacgttctcggcggccgagatggtcgtacctgcccgggcggccgctcga

SEQ ID NO: 345 - DNA, 529 bp, Trichoderma reesei
gcgtggtcgcggccgaggttggaggttctgcacacactctgttgcctcctcggggcttttctatctgtggcgttgccggcacatgcggtccgtgggtcgacggcttttccattctcatcaagcattaggcccgcgtcgacttggacgcaggacgagacgaaaaacagaggcatatattatgcatcttacatcccatttatggattactcgagcatttggacctagctttgccttggacggtcttgtttttgggttttcagtagcaatacactgggggagacaactaatgtgtcgatcagaggccaggaaggatgcacaaacttggtgttcatacacgaagaaaattaggacaaggaggtgaggcacaggctgatttggaccttgtgcccggcgttttggttgaattttgtcgctccctttcagctctacttttttcatcgtgtcgctgggattgagcaaacatatccgagggaggccgaagacgataagattgtcaactctggattgtaaaaaggttacagccgggcag

SEQ ID NO: 346 - DNA, 235 bp, Trichoderma reesei
gcgtggtcgcggccgaggttggagtcaaagtcggcggtctgggcgagggccgaggcgacgagggccaggaaggcagaggcggacagagtgaacttcatcttgacggtttggtttgtttgtttgtttatttttagttgcttggggttttttgaaaggagaaagaaggaatgaagaaggttttttaaaaataaagagtgtgggttgtcgtaagaagacaacctgcccgggcggccgc

SEQ ID NO: 347 - DNA, 420 bp, Trichoderma reesei
tcgagcggccgcccgggcaggttaggaatacccgctgaacttaagcatatcaataagcggaggaaaagaaaccaacagggattgccccagtaacggcgagtgaagcggcaacagctcaaatttgaaatctggccctttcgggtccgagttgtaatttgtagaggatgcttttggcaaggcgccgcccgagttccctggaacgggacgccacagagggtgagagccccgtctggctggccgccgagcctctgtaaagctccttcgacgagtcgagtagtttgggaatgctgctcaaaatgggaggtatatgtcttctaaagctaaatattggccagagaccgatagcgcacaagtagagtgatcgaaagatgaaaagcaccttgaaaagagggttaaatagtacctcggccgcgaccacgc

SEQ ID NO: 348 - DNA, 315 bp, Trichoderma reesei
gcgtggtcgcggccgaggtaccatgacctttcacgaacctttcccatccgcataaagctctcgtgtatctagctgtcagataggcaaccctgtaaacaagcagcaccgtcaattgctgctactgcaaggcgtcacccccgttgaccgtccagacgcaatactcagagcatcaacctggaactcggtatcgcccgtgctaaacagctcaagcttgatcctctcgctgccgacaccaaactccctcagccgcttcgccatctccatcataaactgctccggtccgcagatgaagtacctgcccgggcggccgctcga

SEQ ID NO: 349 - DNA, 292 bp, Trichoderma reesei
gcgtggtcgcggccgaggtgtttatgatggagatggcgaagcggctgaggagtttggtgtcggcagcgagaggatcaagcttgagctgtttagcacgggcgataccgagttccaggttgatgctctgagtattgcgtctggacggtcaacgggggtgacgccttgcagtagcagcaattgacggtgctgcttgtttacagggttgcctatctgacagctagatacacgagagctttatgcggatgggaaaggttcctgaaaggtcatggtacctgcccgggcggccgctcga

SEQ ID NO: 350 - DNA, 642 bp, Trichoderma reesei
ccaatccgagaagggctccttgagtgacttcgaagtgccacaaagactgtccaaagcttgccagtatcatcgctgcggagaaaatagttgagccgatgagcgagatcaacctgggcgagaagcgctttgcccaggcgacaacaaatggcgctccaatggtcatgagggagatggacatggtgccgatgagatcgatcaatgccggtgacgctccggtaaatggggtgtctggctgttgcgaaagcgtctcgaataccgcttggaaaatgccaaaggcaaaattgatgccgcagcaagtaaacacgatcgtgaaggaggcaatggtaatgatgatggtttgccgatctgcagacgaagctgactacggagcacatgaactcaagaagcataccgattcgaagactgcgtattgggagtatctgtatgctcggttgcgggttcttcttctgctcttgatggtgcatgccgttgggtcaaagcgatgtcatctcgcgtaaatgggccttgggaagaggccgtttcagccatcgtctctgtcgttgtcgacatgacttcaaatgttgagtgtggaaaggtgatggaaggtatggtatatctaagctgagagtgagacagatatgcgtacctcggccgcgaccacgc

SEQ ID NO: 351 - DNA, 245 bp, Trichoderma reesei
gcgtggtcgcggccgaggtaccaccaccggcggatcaccgctcccgcaaacccgacgatgaagaaggacacgccggcaatctcgccatagatcacgctctcttcccggagtatcgcgattcgaccggcaaggccaaagtaggatgagtagcacgaggcgtggatgatgacgaagatgatgcacatggagccggcgatttgatgcaggatgttgaggcgctcgtacctgcccgggcggccgctcga

SEQ ID NO: 352 - DNA, 317 bp, Trichoderma reesei
gcgtggtcgcggccgaggtactacctacatatttagggacaagcgacacgaatcgcatctgtgatattcacaaagagagtcgagttcaagcaaagatcctcacaaggctgtatatcatgagatgtgggttttcatcgccatattcaacaagcagtatcatatgtccatcgtgacaattggctgctgagcctcaggcaacatcatcatccctaagctattgagcataaaattccccgtctcggcgtatatcatgtatgtatcaatctcaaggcggcttaagcagctcgcttgccgtacctgcccgggcggccgctcga

SEQ ID NO: 353 - DNA, 445 bp, Trichoderma reesei
tgctcccaccaccaccgaggctgccaccagcaccaccgaggccgcttccaccacctcggaggagtccaccaccgtggtcaagaccaagactgctcactccaccaccaccgaggcctcgagcaccttcaccaccaccaccaccgtcgcccactccacccacaagcacaacaccaccaccgttgctcccacaggctcggcttccaccaccactggacaccacaccaccgctgcctccacctcctcaaaccccgccgtcaccaccgttcctcccggaagcgccgccggccacctctcttctcccctggccctcgttgccggcgtggccattgccattgccttcttctcttaattctgcagatgcagggcctgggagggaaagggtgccatcccgatttgtttgcgctttaaggctttttctctggtacctgcccgggcggccgctcga

SEQ ID NO: 354 - DNA, 557 bp, Trichoderma reesei
tgctgtctacttccttgtcttttgagcggcttgagcgttcgctttgcttatttctcgatgttcgctgtccgcttcctcacggtcgcggcagcgaatttacacgtccagcttttggttattcgaatggtggaggagagaaaagacgctcttcggaagcagcgccgaggttcgacacctttttcttttcttttcacccccccattcctacttccaactggacagcacatagcgaggcgttttcgggtctggtattgcatggttttttctgttggaaagttgagcgcgcacaaagacgaacggacaaaagcagaaaagtcaaccctttttttgcgtcggcttttcttgtggcaatgtggcgacatgcgcaggtgttattgagcgactttgataagacaatgcgtgtcgtcttctcttttctttcaattgcttttcttgtttgattatacggtggctgctttgcgacttgttgaatgtttcagggatcgtttgggggtttctatagaatttcggcgtcaagcaatcttcaaatcatagatgtacctcggccgcgaccacgc

SEQ ID NO: 355 - DNA, 623 bp, Trichoderma reesei
gtatgacggctgagattgacaggagcgtatcgcgacagtgctgaggagagagcggatgttgcagcgggagcacaccccccccccccccccccggggggggggggggggggggttattacccccaccaactttccccatgattattttgtcaacagccagccgctgtggcataccaggtaagttagaacagaggagagcggctcatagacggggttccgatacgggcaaatggccggtttcctcggtcggcgtggcagtggcattctcggattcctctccggcaacaaatttgttgaatctgttccacatgctgtccgacaccttgttcatgctgggtttagacatccacgaggatgactcctctttcggtgcctgtttcaagcgaaccataaagtcatcgacggccgcctccagcagtgggtggtgatagggcgacctcttcgtctgagaggatattgctgaaaggatggcatcgcaatattgcagagctctgtcccggtagccatattcagccaacgtcatggcatggtgaagcttgtaagctgcgagatgaggggcgccaacgaccgccgaggggatgcccgagagcgtaagaccgtacctgcccgggcggccgctcgaaa

SEQ ID NO: 356 - DNA, 362 bp, Trichoderma reesei
aatcactcttgccaagctcatggaggcggcgaatcatgcagtgcctccgtggcttcgcacgtgttgcgatcgagtctcatatttacgaaaagtttttgacagggtcaagggggtgggcgttggcttttctccgatggggatacaacggctcgtgtatggcagctgggctggatgcgcaacgcgagtcttaggggctagaagcttaggttgatgcaaatattttttcggaaaaaaaaaaaaaaaaaaaaaaaaataagcttgtacaaaaactccatatctacgcgcaacgcgatctagcacagcgccgatgtatcttgacccaaacatgccggggatgaagagtacctcggccgcgaccacgc

SEQ ID NO: 357 - DNA, 285 bp, Trichoderma reesei
gcgtggtcgcggccgaggtacatttcgatccggaactccaagagatcgagtggcacggtgactgttgcgaatcacttcaatgcctggaagtcgctggggatgaacctggggactatgaattaccaagttatcgctgtggagggatggggagggcaaggcggcgtgcagcaaactgtgtctaattaggaccttgagctggctctaagaattgcaatgcgatgttgcctttgaaaaaaaaaaaaaaaaaaagcttgtacctgcccgtgtgcggccgctcgaaagggc

SEQ ID NO: 358 - DNA, 448 bp, Trichoderma reesei
taactctcgtctcgcactcgattcggctcgaacctcgttatgacttgtagttgttttttttttttcaatcaactgaccctcttatactttattttttttcaatatgcccttgccgagcgttcgcactcgggtccttttatccttccttttcccaggttagcaccaaaaaacaaaatagaggccggcagatcagatgtgtgtctgctgtcactgcacacaaaccgccaatggatgaaccccttctcgccaatcccaagctcgctcgcgtcccgtcttttttttctccccccttcgaatgcgggcagccaatagccaaccaacagcccggtgcaacaagaggagaagtgaatcgaatgtcaacaacacagcatttggcagaagacaagaaacagcaacaagtcctagaccccacgatatatataaggtacctgcccgggcggccgctcga

SEQ ID NO: 359 - DNA, 208 bp, Trichoderma reesei
cgagcggccgcccgggcaggtacctggccgtcaacatcatcatcacctttaccgacattgacaactctgtcatgaagatgaactccaacttggcctcacgggcagcatggatggccattgcgaatcttgtcgttgtcattttcctcgctctgaagaacaccccactggcgttcctcacggcgtggtcgtacctcggccgcgaccacgc

SEQ ID NO: 360 - DNA, 209 bp, Trichoderma reesei
gcgtggtcgcggccgaggtacctggccgtcaacatcatcatcacctttaccgacattgacaactctgtcatgaagatgaactccaacttggcctcacgggcagcatggatggccattgcgaatcttgtcgttgtcattttcctcgctctgaagaacaccccactggcgttcctcacggcgtggtcgtacctgcccgggcggccgctcga

SEQ ID NO: 361 - DNA, 555 bp, Trichoderma reesei
gcgtggtcgcggccgaggtcccggccgtgccgccgccgcaacaccagcccagctcgacaatctcccctcctcccgctccgataaagccgcagccgactgggttcgcggaggtggctgcgtctttccagaccgggggcacggccaagccccaggggcgacgaggcgaaaagtcgcagagcaagattcccaacattagactgtctttcatcacggcggcggatcaggcaaagtttgaaactctcttcaagtctgccgtgggagatggctcggcgacgatgtcggcgaaaaggccagggatctcttgatacggtcaaagttggatggcgagtccttatggcacatccgggacattgacagataccacgcgagcgggacaactatactttcccgaattcgcgcttgcatgtatctctgcaactcaagcttaccggcaagacgctgccgccaactctgcccgaccatgtgaagaacgaggtgtccagcatggtcgatatcatcagctttagcgttgctgatgaagccccgccggtagccagtcgaacaatgctccgacta

SEQ ID NO: 362 - DNA, 439 bp, Trichoderma reesei
gagcggccgcccgggcaggtacagcctgactctcttgccccccaagtgatatcatgtgttgtggcatgttgcctttaccgtcggttctggcagtcccatgggcatgttgctcatcaagagtctcaaccttggttttcgtcctccagtattcattcccatcgagatagcaaatagcaagctgctcgacctcatggatagattgcaaaaagaaaagaaaaaagagtctcccaccaccgcccgcataagatacaaacctgtaagaccggcggtgcctccttaggctacgcggccagccatgctgggcccgaaacattggcgcgaggtaatctatcaccttaggtcaaggccagttccgctaaaatagcgagcgcatgtgtgatgcagacacgtagggacgagcgtgttggggggagagcaagagagctgtatgacgtgggct

SEQ ID NO: 363 - DNA, 341 bp, Trichoderma reesei
cgagcgccgcccgggcaggtaccgcagcctgagcatgactcggatgtgtcatcattagcacaatatgatgggcagcaaacattatccacgagggtccacgatccgcaactggatgcggcaatgctggggtaaggagactgcgaatgaggagccacggtagctgtatctgtggttgtgtaggtggaagcactgccagttggtgagttgccgccgggtgaagacgagccgacggatgaggatgctgacgacgtccgtgaaaccaagctagaggaagttgttccgtttggggggtttccgccggttgacgcaaggcactgggagtacctcggccgcgaccacgc

SEQ ID NO: 364 - DNA, 296 bp, Trichoderma reesei
cgagcggccgcccgggcaggtactttccacctctatccggactcttggggaacaaactacacttggggcaatggctggattcagactcatgccgccgcttgtttagcagcaggcaaaccttgcgtgtttgaagaatacggcgcacagcaaaacccctgcaccaacgaggcaccctggcaaacaacctctctcacgactcgcggcatgggtggcgacatgttttggcagtggggagacacttttgccaacggtgcccagtcgaacagtgacccgtacctgcccgggcggccgctcga

SEQ ID NO: 365 - DNA, 374 bp, Trichoderma reesei
gcgtggtcgcggccgaggtacatgccagccttcgtaaaaaaaaaaaaaaaaaccgtcaaaaagacaagaaagaggagtggtaaaggagggtagaacaaggcgaacaatataaagcaatttggaaccaaacgccattcacctcgatggaagacaacgggaaaaatgaacaagtccagacagaaagctcagacaacatcttgcagcccgccgaaaagctggccttataagccagaccggcctttgtcttccgcaagcttgaccagcgtctgcttccgtaacgatacagctgtcgactatcggctaccgttctttttgctgcccaccttgaggcgctctttgcagtcggggcagtacctgcccgggcggccgctcga

SEQ ID NO: 366 - DNA, 392 bp, Trichoderma reesei
tggcttgcccagccatttctcccctctttcgatttaccatcatactctattttcccccccaaacacttgagctcatatatgtcattttcacacaccatatacagacggagatactgcacatacgcaggggatgcgaagagagatgctgactgatttgcgacgattctagatgagaaagaatctgatagaaaaagcgctgacggcgagatggagaagtgcgtttcttataatggtttatatctttatggcttggcatgatgtttacgcaatgtttgaatgggcggtctcgcacatgcacatatatacctgctgctgctgcgctgtgttagaacttttggtttcttataattctatagatggcatttaccgtacctgcccgggcggccgctcga

SEQ ID NO: 367 - DNA, 432 bp, Trichoderma reesei
tcgagcggccgcccgggcaggtcgtgccctcacggaagcaggagagcacgacgacccgatcctgaagaacttgaccagcatgggttactcacgtcctgacgcccttgccgcgctcgagaagtatgactataacttggaaagggccgccaactttctcgccagccagtcttagaaggaaatcaagaatggtgatgtaacttgctcttgaatacagaaaagttgttcatcatggtagatggggaaagtcacggcaacacacagcaagctgctcgttcgttcttttgtagcataggaatgggaggcgggggtctctgaatttttgttgacattgttcttttttcctttgctctttatatccttgttctttttcttgttgcaatgaagggtcagaatgtatctgtacctcggccgcgaccacgctaagggcgaatt

SEQ ID NO: 368 - DNA, 417 bp, Trichoderma reesei
attcgccctttcgagcggccgcccgggcaggtgcaagcttaccttgatacattgttgtttcgtatagttgtctcaaatcaggcgcatctctctagccaaactgaataaacgcctcttaaactcggcgtgatggctggtattgcaatcttgggagctggcatttttgccaccgaggaacacctgcccgctcttgtgctgaacaaggccaatgtcaaggcggtttattctcgttcgaaagctaccgcgtctactcttgtggcggaggcaacgaagcttggtatcggtaatcttgacctttactccgaagacactcctgggcacacgctcgatgatttgctcaaacgtagcgacattgaagcggtcgtcattgtcttgccgattttggtacctcggccgcgaccacgctaagggcgaatt

SEQ ID NO: 369 - DNA, 455 bp, Trichoderma reesei
gcgtggtcgcggccgaggtacaagtggctgaagaaagacgtgctgaaactgaacgcgcgtggaggactttttttcgtgccgggggtatctgaaaaaacatgcgtcttcttgaacagagaagatggcgaaaactcgtagccattagaaactcgaaatccgcaccgtttttttccgaaaccgaacagagaaagaaaaggagggccctattgaagcccagttgaatgatgaaaaggaaaatcgttgcaaacattaacccatgacgggctgaccatatccatgggacatgaagtaaggcgtctgtttcatgggctcgacacagcccgagcagctgcattcggcaacgccgtgctcccatccgctgtggtggttgtaggggtagtgagaggaatacggcgattggcggttggggtaaaacgtattgtgagcgggaggctgggggtacctgcccgggcggc

SEQ ID NO: 370 - DNA, 1129 bp, Trichoderma reesei
tcgagggcggccgcccgggcaggtcggaattggcgcgctcgccgctttcctgtggagcagatacggtaacacgttcaagctcagcaattaaggcgagagcgacagtccgtcaaatggattgccatcttgtggaatgttcatcttcttgcctgaacatttccttgcttcatattttcttgtctcatcttttccctctattattcgggagcatatatttcataggaggcgtctttggactttgtgtgtctgtgtgtggaccaaaaagttttcgtgtatagtatcatgcgtctctttgctgttttgggagaatgactttattttgtgaatcgggcgcttgccgaagcccaggccctgaaatttagcaaaaaactcgtcgtataccgctactagtggggaacaaacgacacctaacgtgcgaagacaagaacatctcaaacatcgattctggggtaacaatctgcgatccacaatagcagtttctggggaagcaatgctggatgttggagaagccctggcggggaaccgcatataattgcatggcccccttcaccgagaaaagcagaggaggtgtcagactccgtctttattgcaagacctagtaggctttgcttacccttcatttcttcagatggatagcagcaaggtgacggaccatgacatcgttcaggatgttgtccatgacgagagcccagtcaaagtcaccatcccgaactgcatgacagcgtctcgcatgcaagccgcgctgctacgggagaatccccacatctttcgaaacagcttcctgaaactatatgggtgcatctttgtcggatacctctgctcagctacaaatggatttgattccaatacctttggcggcctttcagccatccctcaatttaccaggtatttcggcatcaccactcagaaccaaggccttgtcgcggcactttatgtgattggaaacatagctggcagttttgtcgctggtccttgctcggatacatatggtcgccgagtaggcatggccgttggatcggccatttgtgttatcggcgctgtcctgcaaactgcgagcacaaccctctctatgctgatgggaggccgctttattttgggcatgggagctgtacctcggccgcgaccacgc

SEQ ID NO: 371 - DNA, 533 bp, Trichoderma reesei
gcgtggtcgcggccgaggtatttcttcagatggatagcagcaaggtgacggaccatgacatcgttcaggatgttgtccatgacgagagcccagtcaaagccaccatcccgagctgcatgacagcgtctcgcatgcaagccgcgctgctacgggagaatccccacatctttcgaaacagcttcctgaaactatatgggtgcatctttgtcggatacctctgctcagctacaaatggatttgattccaatacctttggcggcctttcagccatccctcaatttaccaggtatttcggcatcaccactcagaaccaaggccttgtcgcggcactttatgtgattggaaacatagctggcagttttgtcgctggtccttgctcggatacatatggtcgccgagtaggcatggccgttggatcggccatttgtgttatcggcgctgtcctgcaaactgcgagcacaaccctctctatgctgatgggaggccgctttattttgggcatgggagctgtacctgcccgggcggccgctcga

SEQ ID NO: 372 - DNA, 426 bp, Trichoderma reesei
tcgagcggccgcccgggcaggtactactgcttcgcgaacatgattgagtttataactcctactggggacagtggcgtgggaggactaaaaggctccgtcattttccctgcttggaatgatgcaggggatagagttgatgcactttcagaggtgtgggaaacctgggagattgctgtggcatttgtgactggcggtggcccgttcgatttgtgtggctcttgcgccatttattgttccagcaaggaggacgatggcaataaagaatggaagtggcggtatggcatctttgatgggggctggggtagcgatatttacaacagtgtcgaagagttcctgggcttctacgcccactttgaggagcagacggaggaaatgttcagaaaggatgtcgttagaatggacttagtacctcggccgcgaccacgc

SEQ ID NO: 373 - DNA, 597 bp, Trichoderma reesei
cgagccggccgcccgggcaggtactcgaagcactggaacgcgccggtaggcagagtgacggtggaggcaatgccgttgggagacaggtccggaagagtggcatcgtcggactcgcggttgtagtcgagaacttggctttggccaccaattcggaggtgcttccctccctgagcggtgtctggcatgatgatgaatgtgacgtggttgctgccgagagcagtctgaagccgaatccaagctctgacatatacatccccagttggcacctgggtagtgccgaagaagatgtgtccacagtagccattggggccaccaacgaccttcatggagttgctgccgctgtgggctactgtggtgtcgagactgacggtgccgccctggttacagtctggtgccgaaatgggccatttagtctgatcccagcccgactcgaagtcgtctgagatttgggccatagagagcgttgagagagccccaagggccagcagagcagtccggcgaaccatgtttgcgcagataatttgttcagctagagagtgaagttgctatgaactcaactactgtattatgaactaggcacctcggccgcgaccacgc

SEQ ID NO: 374 - DNA, 582 bp, Trichoderma reesei
gcgtggtcgcggccgaggtacctataatactcaaaaagccgagcaccttgcacgcatgctatgtatcccatagaacaccacatccataatcaatcctcccaaaatacaaaacaggactgggaaagtatgtcaaagagtagaaaacgaaaatgtaaaagaaaaggaggaggaaaaaaataagagaaaagaaagccaccccttgtggacattggtctccctaaggaagatatccaccactaattaagttgaccagcgtgcgacactcctcacttgacatggacatcatcaccgaaactccatggcactgaagcatccccgatcaggaacatgcttcaactctagctgttgaaacttttcgctcttggagtggaaatagatgccgctaatctctcccttgacctggttgaaacagatgtagtaaaagccctcaaatgaggccccagtgattgttcgaacccggtggtcggggaccaggaaatgctctttccaccgcataaagatgtggtctcgttgtgcgaggtcagtgatggtgacgggccccttgcgagccatcttctggtacctgcccgggcggccgctcga

SEQ ID NO: 375 - DNA, 374 bp, Trichoderma reesei
gcgtggtcgcggccgaggtacttttccgtcggcatgtctctccttgctctggcggtgacgtatctgcccatgttcattcctcctcccggcgcgaagacggctcctccggctccggcgccgctgccatgattgacatacacatgttggttgaggggagattgatgaagaagaaggaagagaggagagatgcagactgccatctggtggggataatgttaatagggtaactggctctggacaaaagttcaaacggcctgatgggaggcgttttcgaggggaataagggggggcgacgagcgacgaagcttttgatgcttgatgatgcgccatcaatgtacctgcccgggcggccgctgaaagggcgaattctgcag

SEQ ID NO: 376 - DNA, 238 bp, Trichoderma reesei
tcgagcggccgcccgggcaggtaccagccagcaacgttggggaagtgaccagtattctgcttctgatagtagtaatcgagaatgaaaccctgattgtattgtccattgatcgtgaagttttggacttgtccatggccgagaacgctcccggcaagacagccaagggctgcaagaatggcgcaggacttcatatcgatggggcttagatccttaaatcagacctcggccgcgaccacgc

SEQ ID NO: 377 - DNA, 328 bp, Trichoderma reesei
gcgtggtcgcggccgaggtaccaccatccatcccgctccaacaagtcagtcatctgcgacacacacgacgataatcaaaacaaacaaaggggttggtcggttaggatacaacaggtctggctgcacttacatcgtagttgatgtcggcgtagcggattgcgctgaaccagtggccaccgctgctgacgttgaccacgcgcttgtccgtcgaagcaaggaccttgtcaaagatcaagttggtcaggagaaagtgacccaggtggttgcacgtgagctggctctcgtatccgtcctcgcagatcttgtacctgcccgggcggccgctcga

SEQ ID NO: 378 - DNA, 456 bp, Trichoderma reesei
gcgtggtcgcggccgaggtacaagctttttttttttttttttttttttttttttttttttttttttttttcattctgcacaaatcatgaatttttcatcatcgcatacaaagttcggccgttcaaaacaagcgcaaaaaactttacatacacgacgtctgacctcctccccgggcttccaatccctttcatatcctctctcccgtcctccccaatttgtttctttcccctcattcccccactgctaccgaaagacaacctagcagagggggggtaaaaagaaaaagagatagaaaaaaccgaaaatcaatccgaatgccttttggctgcgttgccccttccaaacgcaggggccagcgacaaaaaccaaccaaaaagagtcgacgatgggaaacaaaaaaaatgactataccccctatgaacccgtttttatacaaatccccatgcccgaggcgat

SEQ ID NO: 379 - DNA, 453 bp, Trichoderma reesei
catacgtgatgatccgctggttccgcttcacgacaacgaccctcaaagctcccctcgtcgccttggacgattgaccccccattgtgaagaggagacggatgatacgactgttctacgagcaataggctggcggggcgacgcttaccgatttacgatgctacgcactcttcacctaaatttcttcagcttgaagaaaacgagcgatatagagagggcttggggcacctacgactactaccatgtttgtaatggcggggccctcccaggaaggataggtggcgtttggggcgggcgtattctttctgtattcctatcagggatgtttctgtctcaatgtgtcgtgttggctcaatggctaaccactttgcacaacgggaaggaaaaaggcgacacattttggggcagatccggacgggtttgatgttttgtcatgtacctcggccgcgaccacgc

SEQ ID NO: 380 - DNA, 277 bp, Trichoderma reesei
gcgtggtcgcggccgaggtacatatggaaacaaagtaaaaaacatgagcaaaagacaagcacgaaaccccaatgatgaaactagccctacgcctcttccaacggcgtcttcttcaagccgccaccccccgaagcaatcaaatccaagaaaccctttttgctcatctcgttgaccttctcctcccttgacttggcaccaatgatgccctcctttctcgccgccctctccgcctccgccgcctgcacctgagcagcgcgtacctgcccgggcggcccgc

SEQ ID NO: 381 - DNA, 353 bp, Trichoderma reesei
gcgtggtcgcggccgaggtacgcggcatgttttaggctatgatacagctgcataatgcattattactaaaagttctgcaaccccctctctcactctgtattctctctctctgtgagttgctgtatttcgcccctcactcagcagaactctctctctcatacttttctttcctcgccgttgttgtttgtccttgcttccttgcccctccctccctttcaactaattctctttagtccagggagctcgacacggaaaacacactcttcgccccctaatggttcgctctcatcgaatgcttctctgcgtggacagccagcaaaaagaggctggtacctgcccgggcggccgctcga

SEQ ID NO: 382 - DNA, 731 bp, Trichoderma reesei
gcgtggtcgcggccgaggtacttcttaaagatcctaagaaagcatatttactattagcacttcatccagctaataatatcccataagtggctaaagatgatactgctaacataaataatatacctaattccatatcacctatagataatcctggtccatatggaataacagcataacctaataaggcaaatattaatgttataactggccctaaaaaaaataaaattatattagcttgtgtaggtgctacatattcttttaatattaattttaaagcatctgcaaatgcttgaagaagcccataataacctacagcatttggacctagtcttctttgcatactagccatagtttttctttctgctacagttatgtaagctactgctaataacgcaggtagtagtaataataaattttcaataagtgaaataactgttattggtaatttcatttcattattaattttacttattctattaacaatgttcccattttaatcatagaaagttaataatactttgatggctcctacctagctggtgcaaggatggctgcataaaacaaagattaatgtttataaaaagcgtttaatcttaggtcctctaggactataaattgattaactttgtctagtatatgtgaagtatatttaggattttgttccttacttcttatttctaatcttttatgaattcgggtaggggctcgtacctgcccgggcggccgctcga

SEQ ID NO: 383 - DNA, 461 bp, Trichoderma reesei
tcgagcggccgcccgggcaggtccccccttttttttttttttttttttttgcagggcaagggtagtttttgcagtgtaaggatatcatcaatacgtggccaggaagccgctcaatgcactttgtcatgtaatcttgtctcggttcctttctccagcctatgaatctcaactttgtccctctgcttgactggccatgatcttttgccgtaatacctcttctattgtgcggacgttcatctgtttcctttgaacaattacctcgagctccttgagattgccgcctacttccttgacctttgagtcgtagaacttttccgccgatttcagtttcttttcgatcatgaagcctgtgcccacgtccaccaggacggtctcggtgctcgtcaactcgccgctgacgtagagggagttggtcagagggaccaagacggatttcgagcctttgctatcggcggctcggg

SEQ ID NO: 384 - DNA, 318 bp, Trichoderma reesei
acatgacagcaatctcttaatcgtcggctctgttgccaaagtgcagtctgtcaagttaactcactaaccaccccaatactacataccagctcaaaccccccatccactccaagtcaacatcaacagaacctagttgctgacactctgtgaggcagaaccactaccaccccagccttcgacagcgacaacctggtagttcatctgcccaaggtgcaggccaagcgaggcccaagcattgaagtggttctgcacagtaacagttccgctggtcctgggcgagttccgcacggaaatgtacctgcccgggcggccgctcga

SEQ ID NO: 385 - DNA, 259 bp, Trichoderma reesei
tgagcggccgcccgggcaggtacggccagcaggctctcgctttcatcaacagccagctctcctcaggcggttctcaacccccgggcggcggcccgaccagcacctccaggccaaccagcacaagaactggaagctctcctggcccaactcagactcattggggtcagtgcggaggccagggctggaccggtcctacgcaatgtgagagcggcacgacttgccaggttatcagccaatggtacctcggccgcgaccatgc

SEQ ID NO: 386 - DNA, 261 bp, Trichoderma reesei
ttcgagcggccgcccgggcaggtaccattggctgataacctggcaagtcgtgccgctctcacattgcgtaggaccggtccagccctggcctccgcactgaccccaatgagtctgagttgggccaggagagcttccagttcttgtgctggttggcctggaggtgctggtcgggccgccgcccgggggttgagaaccgcctgaggagagctggctgttgatgaaagcgagagcctgctggccgtacctcggccgcgaccacgc

SEQ ID NO: 387 - DNA, 458 bp, Trichoderma reesei
tcgagcggccgcccgggcaggtacgcagggccttgatgagaagaagtattatgaccccgtgagctccacaaagcgttggctgacccctgttgcagttacattgttcctggcctgggagactttggcgaccgattctatacaatttgaagacggcctttttttcccgatgagatcctggtattaagtgtgtgtcgatatccccaagcctgtaacgccctagcctgttcatgtaaggaaatatacagcagcacaatcaatagtcatcgtgcaggtcgctttcttcgtgctcgtcaacggtagatttctccaagggccttcgagcgccgaatgatttggcggtgttgccctctccagcgtcttgtttcgcaacagcctcggcagcatcaacccattctccgtagacgtcaaccgcggccgagagataattgacggcacactgacctcggccgcgaccacgc

SEQ ID NO: 388 - DNA, 293 bp, Trichoderma reesei
gcgtggtcgcggccgaggtacggggctgggccagcgttgcttgtgcgaacaaacagcatggccgtatatggggactccgtcttgcccgagttcttgatgttggcctcgaaggtgaagacgggaatctgctcgctgtaagtgtatccggggtgaggagcagagaggatcgatgaggtgttgaacttgaggctcttggggtggctggcgagagtctccttgaaggtggtgtagaagagaccactgccaaactcgtagacgggtttgccggtgtacctgcccgggcggccgctcga

SEQ ID NO: 389 - DNA, 588 bp, Trichoderma reesei
gcgtggtcgcggccgaggtaccgtctgggagaagaacatgaggcttctccgccatgaatcactagggcggtattcattgagatgcttgatcgaaatatactcaaagaaccccattgcctctgtttggcctgaaccggtcatcggtaagaccataaagggtctgggattctgcgaaatgagaccgtggtgtctcgcacaacaagtttctggacgattcgcaccgcctatggtgtcgccatctgctccgtttttcacgtcgttgtgagaacgacccgattcagtctcgagaggcatatcaccgtagccgtcacagatgcgacctgtggactggcatttcgagcatgaaggctgagaaagatcgcatttgattcgtcttatcttgcaagtcttacagcccagtctcgactttggagcaaacttccgaggcttctttctccaggcttgattggccgccttggtgtcctctttcgccatcccgttcatcacgataattctgaattgaccaataattgcggtaggcgccgtttcaagcagagggtcgtctgttcgtccgatcgtatgtgtgtacctgcccgggcggccgctcga

SEQ ID NO: 390 - DNA, 347 bp, Trichoderma reesei
gcgtggtcgcggccgaggtactgctcgggtgtgtcgatgatggttgaggttgttgttgattcggcgctcttgcgttatggcgtctcgttcagcggctgcagcgatatgatcgtggtattgctcttgttcccaactgtgacgaaaccatcggacattcgaccaagatgtagtaaaagttcactctgcgctgcaggtgatgccgaaagagattggcacgatggatggatgagccggcaatgggattgaggcgttgaattgcgagtgacggagtcgggatcacaagggtgaagtgctggcgatgataggaatagcagcactatggagtacctgcccgggcggccgctcga

SEQ ID NO: 391 - DNA, 487 bp, Trichoderma reesei
tggaattcgcccttttcgagcggccgcccgggcaggtactatgctcacggccaggactgatagataccaccactcaggaacttccttataagctttcatcaagcggttatgaacatctagagcctcagcctcggccatctccttcttcttggacggatggaagctgttaaagagcgaggtgaagccgtggatcacgtcatggcggtggtagagcaggccgtaggtgagggcaccggtgtaaatcgtgaagaagctaaagttggtgattgtgttgccggcagagacgtagggaggcgaataggcatggtatgcatcggggtcaaggataccgcgactgtcgataatggaggagacgttgtaagccttgccgaagcggtcaaagagcgtattagagacgatgggaaagtgggaactgtgaaagctgtcggtgtagtagatggccaagatgacgaggccaaagaaaaaggtacctcggccgcgaccacgc

SEQ ID NO: 392 - DNA, 371 bp, Trichoderma reesei
gcgtggtcgcggccgaggtaccatgaggttaggtgaatacgtcttgatgactgccgcagcagcgggagtgcaaatgacgtgtgacatgtcgcatcccaatcttgcgctggccatggccgagaaatatggcgctcctgtgtagtcctcgctaccaccgatgacaccaactcggccaagctgacccttatggaatgtgtccagcatgggcggaatcatccgcctgaccttgcccagcacgttctttgttgtggcagacatgttgggagtgtctctgtcggcagacattatcagagatgattgggctttgcaaggttcgatcctgaagctgtaaaggtgttgccaatgtgcgacctgcccgggcggccgctcga

SEQ ID NO: 393 - DNA, 448 bp, Trichoderma reesei
gcgtggtcgcggccgaggtacaagccttttttttttttttttttttctgaagaggtagaaaccttcattggattcgactagatatgactgtagacccttgctctccagcaggacattaacgttagtgagaggatagtgattctcaatgaagcgtgcccagcccctagctgcggcttggacgtggtcgctatcgttgatccttttccaaccaatgccgaggtgaagagtaaagtcgtcaatgaccgggtcgtcattcatactgctgtcggtcatgttcgtcgttgttcgtggcatcgtcgacgtcgttttgctataggatgcatgatcactgccgttgagaagcctttgggatttatggttcctcagctgtcgaccagtcggcaatccactcccttgctgttcagtgatcacatcgtcaagcccagtacctgcccgggcggccgctcga

SEQ ID NO: 394 - DNA, 384 bp, Trichoderma reesei
gagcggccgcccgggcaggtcacaaacacaactctcaaccacacacacaaaaccacaaacaaaaccacctttaccacctcaaaccacaatggagaccgctaagcaggctttcaactacgtcgccgagtccatccagggcgcgacttccggtgccagcaaggagaccaacaaggagattgccaagaacgacgaagtccccgtcagcactcgcctgagcgctaccaaggacgctcttggtgacaagatcgacgagactgcccacaacaacaaggcagaggctcacaaggagctggccaagaactagagcgggattgggatttgaatgctttgaaggcgttgcacggatcagagcaaagggaacgggtacctcggccgcgaccacgc

SEQ ID NO: 395 - DNA, 306 bp, Trichoderma reesei
gcgtggtcgcggccgaggtcttggctgttccactgccacatagagctccatttgatgggcgggatgggaatcgtcatcttggacggtgtggatgcatggccagaagacattccagtcgagtatcagctggacaagccgcacgtaacaccaaatgcttgttcttagaattgcaaatatggcatatggcattcgagttcttagacattaattaccttacctagaatttaatattttctttctctctctaaaaaaaaaaaaaaaaaaaaaaaaaaaaaagcttgtacacctgcccgggcggccgctcga

SEQ ID NO: 396 - DNA, 244 bp, Trichoderma reesei
gcgtggtcgcggccgaggtacctgttttcttggggtgtgataaggtatatatatatatgagatatatgtgtgcgtgcgtaatgtgacatgtggtgcaaggaaactcaaaagaaaagtcgtggggtataagagggcgctgttgacgaagtgagcatcacgctgccgtttacagctccagaatcgccgccgccttcttcatcagagcggccgtcttggcaatgtacctgcccgggcggccgctcga

SEQ ID NO: 397 - DNA, 155 bp, Trichoderma reesei
tcgagcggccgcccgggcaggtacttggacacggcagaaatcttcttggtcggcgtctggtagccgtgagatagatgtccaccgtgaggaaggtcgaggcccatcagtcggtcgtgggtatccataagcgccgagtacctcggccgcgaccacgc

SEQ ID NO: 398 - DNA, 339 bp, Trichoderma reesei
gcgtggtcgcggccgaggtgagcgcccacgaaataaggtcaatctggttgcagcctctacttcgctactgctatggcggaggtcaacatcaaggctgcggcatcccatgttgaggacaagcttggtgaaggtgccatcatcgaggcaaaaaatgcctctgacgaagaacattcccagactcttcttcaagccttgaagagcaatcgcaaggctgtcttctggtccatgttaatctccatgagcatcgtcatggagggctacgatacgattctgatgggcaacttctttggatatcccgaattcgccaagaaatacggtacctgcccgggcggccgctcg

SEQ ID NO: 399 - DNA, 256 bp, Trichoderma reesei
gcgtggtcgcggccgaggtacaagaagccaacaagaaaaccggcggcaattgagggaacagagccagtcttagcatatccaatggcgccgcctccggccgtgagagccgcaaggacgaaggaggcatttgacagcgaggagtttgaagacatgatgatcgttctgttcggttatggtaggagcctcaaagcgtatcttttgaagcttcgatcagggtcccgagtgagctctgatacctgcccgggcggccgctcga

SEQ ID NO: 400 - DNA, 714 bp, Trichoderma reesei
tcaataggcgcccctgtttcagtttcaatttggaacttctggaaggtatggtgcttgtaatggcagcttctgacatgacgaaaacatttgaagcacatatcaaaattgttacacttatcgcaacgatagcgtggcccataaatcatacaaccacatgaatcgcaagtatacccataatgacggggtgcggctgtaactggcacagcctcttcatcatcgtatgatatcccttccaagcaccgtatcggagcctccgtgttgcttgcgccactatcgggtctcaatagttgattaagctcttcagaatcgccgaggccgtgatactttgcaacatcgattggtcgccatccgcgatatgttacagcattcttgtttgcttgccggtccagaagaagtctgattgtatcatacgatctgtggcgacatgcccaatgaagtggtgtccaaccgtcgatatcaaccttttcgagtgcctccggctgatgtattagaacaagttccagcaatctgtcattctcgagtccggcgtagaaatggaccatatgacgctgctgattgtcaacttcgcgaattctgttctcctcctcatcgcccttcagcatgtcatagtccgacatcccccagtagctatttcgcggcaacatatgtaatggcagtctgccctccttgtcgcgtgtcccttggttcaggtcacctgcccgggcggccgctcga

SEQ ID NO: 401 - DNA, 372 bp, Trichoderma reesei
gcgtggtcgcggccgaggtacattctgtcagtgcgctcaacaagaacggaagagagacatcaggagaagaacataaaaataacagattgagttatacagtgatatgccttgggaacgctcaacgctcagacaacgacagataaacgccagccaaatcatgagggtgcaatgcccagggactgtcatgaaggaatcccgctgctcgaaatgccatgatgtccaggtccaagggctcacaatctccatatcatacacgcccgaattggcacggctggcccaccaaaagaagggaaatgaaggagagaaaaggacaaaagaaagtcaaaaaaggcacgcatccatcaagtcgtacctgcccgggcggccgctcga

SEQ ID NO: 402 - DNA, 190 bp, Trichoderma reesei
tcgagcggccgcccgggcaggtacctctttcgttaccctcactgtccaccagctctgccttagctccggcggtggtatgatacaagcggacctcgacgtcctcgagatagtcgtaaactgtccgcctttcgccttctttgcccatgaccagaactgtgttctcgcggacgtacctcggccgcgaccacgc

SEQ ID NO: 403 - DNA, 498 bp, Trichoderma reesei
tcgggagcggccgcccgggcaggtactctcagtgcttgtaaagagcatgaaggctgagattatgaggcgtttcgtagccagctgcagttaggactagcttggagaaatctacttatgatgaaattgcataaaaaaaaaaaaaaaaaaaaaaaaaaaagcttgtacaacgccattatgacaaccagaaacttggacccagactgtagtatttgcacacacaaccgtctaccagttgactctacgggcaaagatccttatggaagcagatttggcgctgcgacgcgatggggataagtctacagcaggcaattggatcttggtcttgagtcttggagctcaagctgcagcctcgcgatcagctagtcagcttgcaattgacgcaggtcggactgctctcagtcaggccaagggctgtgcgcaaaatcagcgtttgactgcagaggagaggaggataagactgaagaatctggaggcaaaagacctcggccgcgaccacgc

SEQ ID NO: 404 - DNA, 337 bp, Trichoderma reesei
gcgtggtcgcggccgaggtactcgtttggctccacggtccgcttaatgatgatgccccattgagcaatcaacaacaaagagacaaagccgactattgccaacaataggaggataatcttgatggaaagaagaagcagattcttccagcttgcccaggtgaaagtaaagaacgcgtcagacatcgtggaataacctcggccgcccacggtgtagggcactactttgccattaaaggatctgtcgaaggggataatggtgcgatcttcaaccggaagaagggacgcttgaatgcgcatcagaacgacttggctgggtacctgcccgggcggccgctcga

SEQ ID NO: 405 - DNA, 706 bp, Trichoderma reesei
gcgtggtcgcggccgaggtacccgttgcgaggctgccatcagcaaatggctggatcaatgtcaatggttgtcactctaccattctcaaatcatatcggacaagcccagcgacctctggtcgggctccccaaagaggctttgcctatgcgccatcacggaaagctagctaattgacattggcattgtttccatgcaaccatctccaactaaccacttacaatacggcaaagataagcaacgaacaagggcctacagcccggtccgtccacactatcagccaaccattgctgaaggtatcagttattgattgtattaccgcgctctttgcttatcgttcccgaaaagcggaaagattactttgaagaaccggggaaaaaatcttcatatcgcctcaggtgattgcttcagggccaattgataaaagaatcacattcctaacatccactagcatagcatttgacctaataaatgtcttcttgctctgctttctatcctacacgagactctgtttcgagccatatccaaagtccggcttcttgagctctcctctcgactggctgctcaaatgttttcaacagcataaaggctgatcgagcaacaaccgaggcttcagcaggtttgccaccaacaaccgccaggttacacccgctatcacctgattgctgcctctttcttctcgctggtacctgcccgggcggccgctcga

SEQ ID NO: 406 - DNA, 584 bp, Trichoderma reesei
gcgtggtcgcggccgaggtactgcccttgaccttggtgatatcaacccacgtatcggcggcattgagccacaagagaccgacggacgaatcctttcggtgagcctgcatgaaagggatggagccgtagagggtcatggggctgtcaaggatatactcgaagacgtcggcgttgtttttgtacaagctttttttttttttttttttttttttttttttttcggtagtaaatattcaatttcactgcatagccaaaacaaatccgtcccctgtcgcttatgaatcatcccaataatatgcgccgtgttgtaaacctgtcaaggagcgccccaattcgccgtgcctatgtcccttgttgccttcttcaatcgttttgccgtggccgctggacgactatctgctctcgcagcttttccatcctcgagacgtcaggccttttctcgcagttgttttcatttctttgcctttgcctccttcttctcccgcagcgcctgttcttcctgctctcgcctcttctcgtcggctacatgtatcgttgggtcagttgcacggttcgcaatcggtacctgcccgggcggccgctcga

SEQ ID NO: 407 - DNA, 381 bp, Trichoderma reesei
tttcgagcggccgcccgggcaggtacagccagagagaattgaaatgcactgacacgtttgtttccaccaggcgctatcctgagacgcaagagaccaaatcaccgcaacggttgtcgaactagcaggcctgtggaacgccatttgtcgcagcatttccaccccagcttcaccattcaaccgccgtggcgcagcaccttttcttccccccacgatcacttactagtattagttgacgccgacagacaaaccaaggcttcaacaaacgtggtcaagtggtcaacgcgactgctccgtcttctgctgcgattgctgctgtgcttgctgttgtccctcaaacaggccggtataataaccagcgtagtacctcggccgcgaccacgc

SEQ ID NO: 408 - DNA, 433 bp, Trichoderma reesei
gcgtggtcgcggccgaggtgtgagtgatatgcaatacacaataatcctttaataccacccaacatttttattagacatattttaaagaaaaagtaaaatgaattaattatgtgttgcgcaaaaattataatgaaaaagaatcttaacaaaatatttaataacaatttaaataataattctaaaacaattgctttaagaaaaaaaataggagatataggaaaaaccaaatatttaccttctttttctaaagaatgaaaaaatactatttattcttataataagaatatgttaaaaaatatacctgctaatgatgtaaatattaataaaataattcaaagttattttaatttatatttcaaagatcataaatatgtaggatctaagaaatttatattacttagaagaagacgtacctgcccgggcggccgctcga

SEQ ID NO: 409 - DNA, 520 bp, Trichoderma reesei
gcgtggtcgcggccgaggtgcgggaacgccattgccggcaactggatcgataaaggcgatcgactgcgagagtatcaaatggattctcgtagttgaaaaagatgcaatctttcgctctttgacatctcgctccttttggcatacgtctctcgttggcccaggggtgctcatgacggcaaagggatacccggatttgctcacgtgctccttcttgcagttggtccgattcaactgtcctcagattccagtctttgtcttggccgactacgaccccgacggactcaatatcctccgctactatcgcctcaaatcggatatcatgtctcgagagaggagccctacggctcccgatatacgctggctaggaatcagatctcaggatcttcttgagcttgagacccgtcttgatcaatcggcaacgccattgccaattgacctacagccaccgaatagccaatcatctcaaaaaaaaaaaaaaaaaaaaaaaaaaaagcttgtacctgcccgggcggccgctcga

SEQ ID NO: 410 - DNA, 236 bp, Trichoderma reesei
gcgtggtcgcggccgaggttctggttccagaagctgtccgctacggggtctacgatcaacacgggagctgatgggctgcagactctcgactacgtagtccagtcagccgagcagcacaacctcaagctcatcatcccgttcgtcaacaactggagcgactacggcgggataaacgcctatgtcaacgcctttggcggcaatgcgaccacctggtacctgcccgggcggccgctcga

SEQ ID NO: 411 - DNA, 305 bp, Trichoderma reesei
tcgagcggccgcccgggcaggtacccaatgccaccgcactgcccccagtgagtctgcgtgcagctcgggctgctcgaagtcgtcgagctcctccgtgtagtcgaaaacgtcgtgctggacgcaggcgggggcgggggcgcagtcgagttcgtagtagacccaatgtctccccagcggatgttggagaagacgacgtgcgtgttggggttgttggccaggatgttggatgggttgccctcggtgctgctgcaggggccggcgttgccgctgtcgagccagttcatgtacctcggccgcgaccacgc

SEQ ID NO: 412 - DNA, 255 bp, Trichoderma reesei
gcgtggtcgcggccgaggtacatgtgaatctaaccagacaaacgccgttcccagcaagccgtcaccattgcccattcgggctacgccatctatcacctctctcgagacgcaaacgctagagcacctgcatcctcggcggcttaccatttctgcggagtcttgttggactcggggtccgtggctggatatgttctcggcggtctgacagtccacaagaatgcagcggcctggggacctgcccgggcggccgctcga

SEQ ID NO: 413 - DNA, 540 bp, Trichoderma reesei
tatagtaccgccagtcagtgtgctataattcgcccttagcgtggtcgcggccgaggtaccgccagacggacggcgaaaggccaatctccttggcctggttgccaaagacaccaatgcctcttgacttggaaaacttgccgttctcgtagttcaagtactcggtggtggagaggtggttaagcagggtccagttgtatccagtgccaatctcggacccggggaagatgactgtgtggaagggcacattgtccttgcccatgaactgatagagggtgacctcgtcgggattcttccaccactgctcccacttatccgtatagttggccgtgatggagggatagccgatgcaggcgtcgaaccacacatagatgaccttcttctcatacccgggcaaggggaccggcacaccccacttcagatctctggtgatgctgcggggctccaggccctttgtcaaccacgactgcgtgatggacacgccgttctgaggccacccgtacctgcccgggcggccgctcgaatggagaattccaattactg

SEQ ID NO: 414 - DNA, 458 bp, Trichoderma reesei
gcgtggtcgcggccgaggtactttgcgtgggcgttgctcgataacttggaatggtcagattgctacggacccagattcggcgtcacgttcacagactacaccaccctcaagcgcacgcccaagaagtctgccctggtcctcaaggacatgtttgcggcccggcagagggttaaagtggcggcataaagaaagggaaatttcttcttgcattcagcctctatgcatcttcctctctctttttccctccctccccttgtccctctctctctacctctcatattccctctataccccccgcttcttctcatgaccccatgctccttgcccttggcccctctctgtcgaattctgcctcttatcacgtcttatgcgtctgtttacttgcctttttttttttgtctctttctgtctgtctgtctgcctgtctatgtgtacctgcccgggcggccgctcgaaaa

SEQ ID NO: 415 - DNA, 256 bp, Trichoderma reesei
gcgtggtcgcggccgaggtcggccgaggtttctttttattcatcgtccatcttctgcttctcccccgtggtcctgtgggagatacatcgcccctgctctgtcgcaattgggaacggcagctcgacctgatctctcgcacctgttattgccaccccgcaccaactgggtcgtgccaacgaggcagacgacatcccgccgctaagatgcccatcctcaaggagccgtggaagaagtacctgcccgggcggccgctcga

SEQ ID NO: 416 - DNA, 321 bp, Trichoderma reesei
ttcgagcggccgcccgggcaggtactcgccaacctgctgcgcggtgaagacaaagtcgccctgtcgctccttttcgccctgcaggatcaccttgccgccggggccctcgacgatgtagtcgacatcgaatgaaccacccgattgcacagcaaagtaaaaggcaatcttctcgttcgggttcttggtggccgcgtagaagcaggccctttcgttggcggtcagcttgtaggtcaatgccgtggcggcgacattggaggccatcaaggccatcaggccagctaccagcgttggcagtctcatcgacctcggccgcgaccacgc

SEQ ID NO: 417 - DNA, 400 bp, Trichoderma reesei
gaggtctttggctatgtccatccatctagtcaaatgattggatataacatgatggatggacatagccaaaacaacagcgtcttcctccccatttccgcaggtcctagtatttctccgtggccagctgcttgggaatgtcctctagatcctccgccgactctatatcaatgaccttgttgacctcggccgtgttgcgtatcagctcctttgcgccggcgtagagcattctcgtttcggcgtttgtcgtgatggggaggtagtagagcagcacgtagggcaccgataaccgtccgtcgggcattgtcaggggatagctgaggaggatgaatcggggggcatggtcgggcaggtcttcggctatctcgtcgagggaggtgtacctgcccgggcggccgctcga

SEQ ID NO: 418 - DNA, 218 bp, Trichoderma reesei
gcgtggtcgcggccgaggtacagtaataggtagccaaggggaagcatcgcctggagtaggactgcctacatctgcagtgtccgaaatccgtttcaaacgtgtgttgtagtgcaattttgtcagagcatatcaatgcatgtcggtgcagagcgcccaagccttatcagctactgtagataaaaagtagaagctcagtacctgcccgggcggccgctcga

SEQ ID NO: 419 - DNA, 376 bp, Trichoderma reesei
gccgtggtcgcggccgaggtacaagtgtaactcaggggtgaaaggcgtagtgaaggcctttgtataatgaagccgtttccgcgtccgtcaatgacgccggtttcccaaaaaagagatctctgatgcagtttctgtggctttctcacctagcttggagtagaatctgagtcaaacagcaagacgctggaaggacctgacgggaaatccaagttcacagcatcccccggcgtagagaatggaagttcagatgccaggtgtgacctctgtcaacctctgtcgtccaaacacacgagccttgacccccttgtgcaacgcgcggcagcctctgagaggatgcattgggcatcatcaacgctgagacggtgacctgcccggc

SEQ ID NO: 420 - DNA, 269 bp, Trichoderma reesei
gcgtggtcgcggccgaggtcggccgaggtacgactgacggagccgtcgtcctcctcttcttcgcgaacaagcatggagttggggtctgccgacggctccacaatgtcagctctcaccatctcaacagcctcgttagacatctggtatgctgagatgccaatgtatccatcttcatcgcctgtaatcacacaggtgacaaagttggaaccgaactggccagagtcactccattttgacggcttagggtacctgcccgggcggccgctcga

SEQ ID NO: 421 - DNA, 441 bp, Trichoderma reesei
tcgagcggccgcccgggcaggtacgatgaatcatggctaagcataattcaagaggagaaaaaggattgataaccaagagctagacgagcgcgaccagaagcatcgcgatatcaaagtcatggggtggtggcgagaggcggacttgaaaatcctatatttactgtctataagacatacatttccctgaacctcgattcagtgcaagtcgcaatgatcttgacccgcctgtcccaatcaaataatgatgctttaatccttgccgaaccaggtgttgtggccggcgacctttcggctggcagcgtagatggaagctacgacttcttagctctctggttccatagctactgttataccaatcaacttacctccgaaacctccccaccgctaccttggtgttgacctcttcaccaagcagctgcacgaggagtcctccttcatctc

SEQ ID NO: 422 - DNA, 530 bp, Trichoderma reesei
tggatgggatattctggcagaatttcgccccttttcgagcgggccgcccggggcagggtcaagtaagtcatatgctttgtctccaaagataaagcccatgcatgtctaaagtataaagcaatttatacccgcgaaaactgcgaaatgggctcatttatataaagttatcgttttattttgataatacttttactacttgggataacccgtggtaatttctagaagctattacatgctgaaaaatcccgacttcggaaggatgtatttattagattaaaaaccattgcccctcggggtctctggtgaatcatgataactagtcgaaatcgacaggccttgtgccggcgatggctcattcaattttcttccctatcaactttcgatgtttgggtattgccaaacttggtggcaacgggtaacggagggttagggctcgaccccggagaagagcctgagaacggctactacttccaaggaggcagcagcgcgcaatttacccaatccacttcggccgcgaccacgctaaggcg

SEQ ID NO: 423 - DNA, 261 bp, Trichoderma reesei
cgagcggccgcccgggcaggtcgaaggatcaaaaagcgacgtcgctatgcacgcttggccgccacaagccagttatccctgtggtaacttttctggcacctctagcctcaaatgtcgagggactaaaggatcgataggccacactttcatggtttgtgttcacactgaaaatcaaaatcaaggggacttttacccttttgttctactggagatttctgttctccatgagccccccttaggacacctcggccgcgaccacgc

SEQ ID NO: 424 - DNA, 385 bp, Trichoderma reesei
tcgagcggccgcccgggcaggtgcgttcatagcgacgtcgctttttgatccttcgatgtcggctcttcctatcataccgaagcagaaatcgaggcgaaggacggcttaccctcagcagatcgtaacaacaaggctactctactgcttacaggaccgtttcgcacagctaagtcgtctgcaaaggatttaaccccgctcgtgttgaaattacaatacgcgaaataccgcggcccgcttcgaggaccgcggaggaatcgcctgctgagacactaagccgaagcctattcttgtccgtctatacgtgcgggtgctatcaccgcgttctggcatggattctgacttagaggcgttcagccattatccagcagatggtagcttcgcggca

SEQ ID NO: 425 - DNA, 287 bp, Trichoderma reesei
gcgtggtcgcggccgaggtacagcagtgaggaattttggtcaatggcctaacggctgaactggcaacttggagaagtggcaagtcctattttgatcatatctttgaatatgatctataggattgtattaaaattgaataaagctttgtttatatattgataatgacagtatatatatcgtgtcttgactaattgcgtgccagcagtcgcggtaatacgtaagagactagtgttattcatcttaattaggtttaaagggtacctgcccgggcggccgctcgatttgtt

SEQ ID NO: 426 - DNA, 416 bp, Trichoderma reesei
gagcggccgcccgggcaggtacggacaaggggaatctgactgtctaattaaaacatagcattgcgatggccagaaagtggtgttgacgcaatgtgatttctgcccagtgctctgaatgtcaaagtgaagtaattcaaccaagcgcgggtaaacggcgggagtaactatgactctcttaaggtagccaaatgcctcgtcatctaattagtgacgcgcatgaatggattaacgagattcccactgtccctatctactatctagcgaaaccacagccaagggaacgggcttggcagaatcagcggggaaagaagaccctgttgagcttgactctagtttgacattgtgaaaagacataggaggtgtagaataggtgggagcttcggcgccggtgaataccactactcctattgtttttt

SEQ ID NO: 427 - DNA, 391 bp, Trichoderma reesei
tcgagcggacgcccgggcaggtccgaagcagaaatcgaggcgaaggacggcttaccctcagcagatcgtaacaacaaggctactctactgcttacaggaccgtttcgcacagctaagtcgtctgcaaaggatttaaccccgctcgtgttgaaattacaatacgcgaaataccgcggcccgcttcgaggaccgcggaggaatcgcctgctgagacactaagccgaagcctattcttgcccgtctatacgtgcgcgtgctatcaccgcgttctggcatggattctgacttagaggcgttcagccacagcagtgaggaattttggtcaatgtccagaacggctgaactggcaacttggagaagtggcaagtcctattttgatcatatctttgaa

SEQ ID NO: 428 - DNA, 255 bp, Trichoderma reesei
cgagcggccgcccgggcaggtgtgaaaagacataggaggtgtagaataggtgggagcttcggcgccggtgaaataccactactcctattgtttttttacttattcaatgaagcggggctggatttacgtccaacttctggtattaaggtccttcgcgggccgacccgggttgaagacattgtcaggtggggagtttggctggggcggcacatctgttaaaccataacgcaggtgtcctaaggggggctcatggag

SEQ ID NO: 429 - DNA, 203 bp, Trichoderma reesei
cgagcggccgcccgggcaggtcgaagcgggccgcggtatttcgcgtattgtaatttcaacacgagcggggttaaatcctttgcagacgacttagctgtgcgaaacggtcctgtaagcagtagagtagccttgttgttacgatctgctgagggtaagccgtccttcgcctcgatttctgcttcggacctcggccgcgaccacgc

SEQ ID NO: 430 - DNA, 156 bp, Trichoderma reesei
gcgtggtcgcggccgaggtttcgcgtattgtaatttcaacacgagcggggttaaatcctttgcagacgacttagctgtgcgaaacggtcctgtaagcagtagagtagccttgttgttacgatctgctgagggtaagccgtccttcgcctcgatttc

SEQ ID NO: 431 - DNA, 385 bp, Trichoderma reesei
gcggccgcccgggcaggtacatatcaaggttgacgtgatcgctgtgttgcgctcggtcgtccacatccctccacgtcactttgttcttcaagcaggatatgttgatctctgaagcctgcgtcttttcttcaggtctggcggagatcatggcattgtcatcgccgacatcagcggcattgcgtgagtcatgcgaagggggagcgtcatgatctgaaggctgatagtagtggcttgggctatcaaaggtcagtgactacacagcttagtgatgcgaggcgtgtgaacatgatataaatataaggggaagacgaagccaatgaacaattccatccactccacctcatggccgccatccatgacttagcgccgctgtcaacagagatgg

SEQ ID NO: 432 - DNA, 399 bp, Trichoderma reesei
gcgtggtcgcggccgaggtacaaattgggggatcatgaagattttatcagtgagtatgtagactcggaatggcaaagatatatcttaaattatcagacatagaatgataaggttgtatgtcaaaagggaaacagcccagaacaagagttaaggttcctaaattatttgttaagtgaaaataagaaggtttttatttaagtcgacaaggagataggcttagaagcagccataattttatgacctcgtaacagagcgcttgttaaattgtaaaagcgtcgaaaatataacggatctaaacaatataccggaaaacttgtccataatatattataataaaatatgtttattgtaattaaatggggtagcagaacgttgagctaaaatatgagttttattttt

SEQ ID NO: 433 - DNA, 255 bp, Trichoderma reesei
gcgtggtcgcggccgaggtaattttatgacctcgtaacagagcgcttgttaaattgtaaaagcgtcgaaaatataacggatctaaacaatataccgaaaccttgtccataatatattataataaatatgtttattgtaattaaatggggtagcagaacgttgagctaaaatatgagttttattttttaaataaaattatagtaatttaactcaagggagaagatgacgacgaaacctgcccgggcggccgctcga

SEQ ID NO: 434 - DNA, 333 bp, Trichoderma reesei
gcgtggtcggggcgaggtacagagatgttttgcaagagtgctttgtcgtaaaagaggaataagggtaccgcacgagaggtccgctccgggaaaaaacagaaaggagaaaggaagcgtttcggtcgtgttgttgaggtcatgtagtataagggccagccttggatggttacttgggcggccggatggagagttcttgcggtgccatgtaatggtttgttttgtgtggtgctgatgagggtgtaagtattgcgcgttgtcgagagatcgatggtagtattgtcgagacggacctctgtcaattgagacgcctagtagtctcgacaagacctgccc

SEQ ID NO: 435 - DNA, 255 bp, Trichoderma reesei
gcgtggtcgcggccgaggtactgttgccaatgcggtggcatgattgtcatcagcacgacctgcacttgctgcggccacaagcagtgctcccactgccccatgtgctagacgactgcacacaaggacttgtcgagactactaggcgtctcaattgacagagcaccacacaaaacaaaccattacatggcaccgcaagaactctccatccggccgcccaagtaaccatccaaggctggcacctgcccgggcggccgc

SEQ ID NO: 436 - DNA, 376 bp, Trichoderma reesei
gcgtggtcgcggccgaggtacagagatgttttgcaagagtgctttgtcgtaaaagaggaataagggtatcgcacgagaggtccgctccgggaaaaaacagaaaggagaaaggaagcgtttcggtcgtgttgttgaggtcatgtagtataagggccagccttggatggttacttgggcggccggatggagagttcttgcggtgcatgtaatggtttgttttgtgtggtgctctgtcaattgagacgcctagtagtctcgacaagtccttgtgtgcagtcgtctagcacatggggcagtgggagcactgtttgtggccgcagcaagtgcaggtcgtgctgatgacaatcatgccaccgcattggcaacagtacctgcc

SEQ ID NO: 437 - DNA, 383 bp, Trichoderma reesei
ctttagcgtgggtcgcgggcccgaggttacagaagatgtttttgcaaagagtgcttttgtccgtaaaaagagggaaataaaggggtacccgccacgaggagggtcccgcttccggggaaaaaaacagaaaaggagaaaaggaaagcgttttcgggtcgtgtttgtttgaggtcatgtagttataagggccagccctttggatggttacttgggcggccggatggagagttcttgcggtgccatgtaatggtttgttttgtgtggtgctgatgagggtgtaaagtattgcgcgtttgtcgagagatcgatggtagtattgtcgagacggacctctgtcaattgagacgcctagtagtctcgacaagacctgcccgggcggccgc

SEQ ID NO: 438 - DNA, 337 bp, Trichoderma reesei
gcgtggtcgcggccgaggtactgctagtcgaaaagaggagagagtcgtctctgagcgggccatgccgaaagccaccgacacacgtgaacaagcaggggtgggcgcggacgtgaggaggcagaatttccccttccctctcggtctcttttggctaggcactggaggaagaattggtgtcagtaggtcgcttctactctattttctgcttcccccccttcagtctggtgcgaggcatgtccggacagaaggagcatggtcatcgttgcggtgttggggatttccccggcagtgtccccgtcgtatttggtacctgcccgggcggccgcccgggcaggtg

SEQ ID NO: 439 - DNA, 263 bp, Trichoderma reesei
gcgtggtcgcggccgaggtactacaaataacattgacggcgccttttctccgcttgccacttggctccgacagaacaatcgccaggctatcctgacagaaaccggtggtggcaacgttcagtcctgcatacaagacatgtgccagcaaatccaatatctcaaccagaactcagatgtctatcttggctatgttggttggggtgccggatcatttgatagcacgtatgtcctgacggaaacaccgactggcagtggtaactcat

SEQ ID NO: 440 - DNA, 496 bp, Trichoderma reesei
cgagcggccgcccgggcaggtcctagcttgactggagccatggccactgctgcagcagctgtcgcaaaggttccctcttttatgtggctagatactcttgacaagacccctctcatggagcaaaccttggccgacatccgcaccgccaacaagaatggcggtaactatgccggacagtttgtggtgtatgacttgccggatcgcgattgcgctgcccttgcctcgaatggcgaatactctattgccgatggtggcgtcgccaaatataagaactatatcgacaccattcgtcaaattgtcgtggaatattccgatatccggaccctcctggttattggtatgagtttaaacacctgcctccccccccccttcccttcctttcccgccggcatcttgtcgttgtgctaactattgttccctcttccagagcctgactctcttgccaacctggtgaccaaggtcgacacaacctcggtaacctcggccgcgaccacgc

SEQ ID NO: 441 - DNA, 212 bp, Trichoderma reesei
gcgtggtcgcggccgaggtgattgcgctgcccttgcctcgaatggcgaatactctattgccgatggtggcgtcgccaaatataagaactatatcgacaccattcgtcaaattgtcgtggaatattccgatatccggaccctcctggttattgagcctgactctcttgccaacctggtgaccaacctcggtacctgcccgggcggccgctcga

SEQ ID NO: 442 - DNA, 364 bp, Trichoderma reesei
tcgagcggccgcccgggcaggtggaaactctggtggaggctcgcagcggttctgacgtgcaaatcgatcgtcaaatatgggcatgggggcgaaagactaatcgaaccttctagtagctggtttccgccgaagtttccctcaggatagcagtgttgaactcagttttatgaggtaaagcgaatgattagggacccgggggcgctatattgccttcatccattctcaaactttaaatatgtaagaagcccttgttgcttaattgaacgtgggcattcgaatgtatcaacactagtgggccatttttggtaagcagaactggcgatgcgggatgaaccgaacgcgaggtaaggtgcagagtagacgc

SEQ ID NO: 443 - DNA, 535 bp, Trichoderma reesei
cgagcggccgcccgggcaggtgggtgtcaaacccctacgcgtaatgaaagtgaacgcaggtgagagcttcggcgcatcatcgaccgatcctgatgttctcggatggatttgagtaagagcatacggggccggacccgaaagaaggtgaactatgcctgtatagggtgaagccagaggaaactctggtggaggctcgcagcggttctgacgtgcaaatcgatcgtcaaatatgggcatgggggcgaaagactaatcgaaccttctagtagctggtttcccgccgaagtttccctcaggatagcagtgttgaactcagttttatgaggtaaagcgaatgattagggacccggggcgctatattgccttcatccattctcaaactttaaatatgtaagaagccttgttgcttaattgaacgtgggcattcgaatgtatcaacactagtgggccatttttggaagcagaactggcgatgcgggatgaaccgaacgcgaggttaaggtgctagagtagacgctcatcagacaccacaaaa

SEQ ID NO: 444 - DNA, 303 bp, Trichoderma reesei
cgagcggccgcccgggcaggtgtgaacgcaggtgagagcttcggcgcatcatcgaccgatcctgatgttctcggatggatttgagtaagagcatacggggccggacccgaaagaaggtgaactatgcctgtatagggtgaagccagaggaaactctggtggaggctcgcagcggttctgacgtgcaaatcgatcgtcaaatatgggcatgggggcgaaagactaatcgaaccttctagtagctggtttcgcccgaagtttccctcaggatagccggggttgaactcagttttatgaggtaaag

SEQ ID NO: 445 - DNA, 323 bp, Trichoderma reesei
gcgtggtcgcggccgaggtccaggccagcatcagttcgtcgcgggggaaaaaggcttcgggaacgtggctcccctgggagtgttatagcccgttgcataataccctgcggtggactgaggaccgcgcatctgcaaggatgctggcgtaatggtcaccagcgacccgtcttgaaacacggaccaaggagtcgtcttcgtatgcgagtgttcgggtgtcaaacccctacgcgtaatgaaagtgaacgccggtgagagcttcggcgcatcatcgaccgatcctgatgttctcggatggatttgagtaagagcatacggggcccgga

SEQ ID NO: 446 - DNA, 131 bp, Trichoderma reesei
atcaaggccatgatgacttgtctttgtcccctttttctttccaaattccaggatcaaatgctttatcgtaaataaaaaaaattaaaaaaaaaaaaaaaaaaaagcttgtacctgcccgggcggccgctcga

SEQ ID NO: 447 - DNA, 482 bp, Trichoderma reesei
gcgtggtcgcggccgaggtacaattccagtgtggtgcgatctagtatcttccacccatccgtcatgcccttaacccgctgcgcccgtgccatatctatgccatgcatttgccttcccttcattggcacagccggtgccttttctctcaatatctctgctttccagtgccagacactaggaggaccacgctgcccagctgccgcctcacgtcttcctggttcacgtcatgggtatcctccacctctccccactgctcagcctgccacttgaggaggagagatgaaattctatgataccaaagggactcggtaaaggcgaaggcaaccttctatgtaaaaactgacgttaaaggacgaaggcacagagcacaaacaggattagatacccaagtagtctctgcagtaaatgatgaatgccataggttagattacgatttagtattataattaaaaattaaatattaaacatgatctggtctataa

SEQ ID NO: 448 - DNA, 261 bp, Trichoderma reesei
tcgagcggccgcccgggcaggtaagaaaaaggggacaaagacaagtcatcatggccttgatattgtgggctatagacgtgccacatatgcctggacaaagagatgcaaaaatgtgaatttaagctaatctcaaaaaacaggatataaattttaaggattgtagtctgaaattcgactatatgaataagtaattactagtaatcgtgaatcaccatgtcacggtgaattaaccttggattggtaccgcggccgcgaccacgc

SEQ ID NO: 449 - DNA, 521 bp, Trichoderma reesei
gcgtggtcgcggccgaggtaccaatccaaggttaattcaccgtgacatggtgattcacgattactagtaattacttattcatatagtcgaatttcagactacaatccttaaaatttatatcctgttttttgagattagcttaaattcacatttttgcatctctttgtccaggcatatgtggcacgtctatagcccacaatatcaaggccatgatgacttgtctttgtcccctttttctttccaaattccaggatcaaatgctttatcgtaaataaacaaaaaataaagccagggattacgttaattacatggaaaccacagtttcacaacattaacctgaaaacagccgtgcaactcctgtaagccccgcgcccctccccccccgccctcccatcctcaacaaacggtctagtgatttcagttcctgcgttgccacattactcttgaggtgaaatgcttacactttcatttatagaccagataatgtttaatatttaattttaattataatactaaatctt

SEQ ID NO: 450 - DNA, 517 bp, Trichoderma reesei
tcgagcggccgcccgggcaggtacatgtcaggcagccatgctttcgtaaactgcctcctccagacacttgtagagtaattttagaaccgccatcggcatagtcgtcgttgtctccagtagccgcaaccagctgagtcgtccggcaacggtgtcaagtgggtttcaagaagaatgggtcttcttggacatggagaacgttggagtcatttcataagcgtcaacatgttcggacgcgaacttgcgggcagaaatcctctttgcgaataagatgtccagctcttcatacgttcgtcctttcgtttcgggaagtcggaaataggcccaaataaacatgatcagagcggtgccgccccagaagaaccccgtctttccagacgcgttccaagcggtcgggttcataaagtacggctcaaggacctgggatgcaacgttgataatctgataggccgcccgggccagcgaaacggtctctgggcgcagacgtgtggacgatgtctcggacacgatagaatacgtg

SEQ ID NO: 451 - DNA, 305 bp, Trichoderma reesei
gcgtggtcggggccgaggtctacagtccagctacactcgttgtcagcaaacacaatccccccccaaaacaccaaaaaaacaaaaatcaccaccttctataatccaatccaccccctctcttaataccgccaagatgaagaccgcctttgttgcccttgccctcgccgctctggtcaggcccagacccgcgccgacatcccctcgtgcgctctgcctgcctcgacgacgccgtcaaggacaacaccaagtgctcgaccaccgactacgcctgcatctgcaagaacttcgacgctgtccagggcgct

SEQ ID NO: 452 - DNA, 523 bp, Trichoderma reesei
gagcggccgcccgggcaggtacgcatctcagtcgagggtgtggttcggcatcatgaatgagccccacgacgtggaacatcaacacctgggctgccacggtccaagaggttgtaaccgcaatccgcaacgctggtgctacgtcgcaattcatctctttgcctggaaatgattggcaatctgctggggctttcatatccgatggcagtgcagccgccctgtctcaagtcacgaacccggatggtcacaacgaatctgatttttgacgtgcacaaatacttggactcagacaactccggtctcgttgtcagcaaacacaatccccccccaaaacaccaaaaaaacaaaaaatcaccaccttctataatccaatccaccccctctcttaataccgccaagatgaagacgcctttgttgccttgccctcgccgctctggctcaggccagaccgcgccgacatccctcgtgggctctgccctgcctcgacgacgcgtcaagccaacacaagtgctcgacaccgactacg

SEQ ID NO: 453 - DNA, 435 bp, Trichoderma reesei
gcgtggtcgcggccgaggtacttcaatcggtctaaatacatggacagcacattacaacaaagatgtctttggggatgatgctgcagaattccggccagagcgatggctggaggccgaagaggagggtggacgcaagttggcccagatgactgcatactacctaccatttggcttgggatcccggacatgcatcggccgacacatttcttatttggaaatgtcaaagctcatcccattgctgatcagaaacttcgacttcgagctacaagacaaggagagggagtggaagacaacgaactactggtttgtcaacccaacaactttaatgttactgtcagagctagggcaatgccctgagcaaaggaaggcatggtagataactacgaaaccacatgtattgcctctctatttcttcacaagtaacggtacctgccc

SEQ ID NO: 454 - DNA, 449 bp, Trichoderma reesei
gcgtggtcgcggccgaggtacagcgtatcccctgctttgaaagaccctaccggcactacccttcgtggcaacttcgcagctccaaacggcgattactacacccaattctggtcctcgttgccaggagccctcgataactacctgtcctgcggcgagtgcattgagctgatacaaacaaagcccgatgggaccgattatgctgtcggagaagccggctacacggatccaattactctcgagattgtggacagctgcccgtgcagcggaaactccaagtggtgctgtggtccgggcgccgatcattgcggagagatcgacttcaaatacggctgtcctcttcctgctgacagcatttcatctcgacctgtcagacattgccatggcggttgcaggcaatggatcactaacaatgcgcatccgactcgattagagagtcaatgcccaagtgg

SEQ ID NO: 455 - DNA, 394 bp, Trichoderma reesei
gcgtggtcgcggccgaggtactacatgcgccaaccgaatggccctggctaacatctcgcaggtggtccgggcgccgatcattgcggagagatcgacttcaaatacggctgtcctcttcctgctgacagcattcatctcgacctgtcagacattgccatgggccgtttgcagggcaatggatcactaaccaatggcgtcatcccgactcgatatagaagagtccaatgccccaaagttgggaacgcctacatttggcttcgaaatggcggagggccttactattttgctctcacggcagtcaacacaacggaccgggctcagcacaaaacaacagccacaatgtctgatcactgccgccttggccatgacccaaactatacgagtagccgcccac

SEQ ID NO: 456 - DNA, 415 bp, Trichoderma reesei
gcgtggtcgcggccgaggtacaccacatacttgaagcattgagaatctagcctacatcattgtcccacagcaagaagcccattgcccaatgcttgccatcaattctggctaaactgcacaccaatgtcaatgtagtaaaaattggggtcacctgtggccggaggagtgaatgtcttgatggcctgttcattcacaatctgttcccccgttgggctagtcagacgaattccaacaggcaagttaaagggccctgatccctgtgggattacccaactgccatagcgttcttgtgggcggctactcgtatagtttgggtcatggaccaaggcaacccagttgtcggtgtctgcgcccttgatctcgattttggtgactgagcccggtccgttggtgacctgcccgggcggccgctcga

SEQ ID NO: 457 - DNA, 311 bp, Trichoderma reesei
tcgagcggccgcccgggcaggtggcgattactacacccaattctggtcctcgttgccaggagccctcgataactacctgtcctgcggcgagtgcattgagctgatacaacaaagcccgatgggaccgattatgctgtcggagaagccggctacacggatccaattactctcgagattgtggacagctgcccgtgcagcgcgaactccaagtggtgctgtggtccgggcgccgatcattgcggagagatcgacttcaatacggctgtctcttcctgctgacagcattcatctcgacctgtcagacattgcca

SEQ ID NO: 458 - DNA, 100 bp, Trichoderma reesei
ggagcggccgcccgggcaggtaccaacttgatgttcgttccattagatcaccaagaggaagcagtcctaaagacagcagcagaccggccatgggtcggct

SEQ ID NO: 459 - DNA, 463 bp, Trichoderma reesei
gcgtggtcgcggccgaggtaagatcatcagggaggagaacaaggccttgactgagtaaagaacgacctctgagacggtgaagcactcttccccattgactctaccgcgtcactgaaaaaaacaaagaaaaaaacactgctgctgggatcagacacggcacggaggagtggattcgtgatttctgcgactgcttcatgtcctatggtctcaagactggcgtatatggatcgcatcaagcctcgattgttttcttggatttcttgatataattttttttctgcccttatttcttatcttcctctactactcttttagtttctcctgcgaggagctccgaatctctgacgggagcagtgggttgtccggtcgtgttgtgcttgggcttgggatgtatctgatgggaaaggacgggcagcagtgtgtgtatcaacagctacgaagtacctgcccgggcggccgctaa

SEQ ID NO: 460 - DNA, 427 bp, Trichoderma reesei
tcgagcggccggcccgggcaggtggccttgactgagtaaagaacgacctctgaggcggtgaagcactcttccccattgactctaccgcgtcactgaaaaaaacaaagaaaaaaacactgctgctgggatcagacacggcacggaggagtggattcgtgatttctgcgactgcttcatgtcctatggtctcaagactggcgtatatggatcgcatcatgcctcgattgttttcttggatttcttgatataattttttttctgcccttatttcttatcttcctctactactcttttagtttctcctgcgaggagctccgaatctctgacgggagcagtgggttgtccggtcgtgttgtgcttgggcttgggatgtatctgatgggaaaggacgggcagcagtgtgtgtatcaacagctacgaagtacct

SEQ ID NO: 461 - DNA, 161 bp, Trichoderma reesei
tatctgcagaattcgccctttcgagcggccgcccgggcaggtacgcgacgttgaggcgacaacttggtctttggttacaagagagcccagagaagcgagtgtgggtttttggcgggagcagcctctcttagtatgcggtggtcctcgtttgcggggaggag

SEQ ID NO: 462 - DNA, 296 bp, Trichoderma reesei
gcgtggtcgcggccgaggtacgcgacgttgaggcgacaacttggtctttggttacaagagagcccagagaagcgagtgtgggtttttggcgggagcaggctctgctagtatgcggtggtcctcgtttgcggggaggagagactgctgatctatacagatatctgctgggcggtgggtagcgctggtgataacgattcttctctggtcaaatgagcgaggctcttgtcgtcggtagttgcaggatcgagatgcgatgtgagggtgtgtgagtgagacctgccccgggcggccgctca

SEQ ID NO: 463 - DNA, 110 bp, Trichoderma reesei
gcggccgcccgggcaggtgtcgtctactttttcattcccgagaccaagggacgcactttggaagagcttgacgaaatcttcgaggccaagaacccggtcaagacgtcgac

SEQ ID NO: 464 - DNA, 413 bp, Trichoderma reesei
gcgtggtcgcggccgaggtttcattcccgagaccaagggacgcactttggaagagcttgacgaaatcttcgaggccaagaacccggtcaagacgtcgacgacgaagaaggccgtggccgtggacagccacggcgacattgtcaatatcgagaaggcttaatgccacggacttttacttgcggtcacgatactataccactatatcaagaatatctgggcagttgtgcgcagggcttggggctgtgagctgatgttttgtttcgatggttccttgtcagggcagaggaaacaactttggttgctatttttagctgttacttttgtttccgctgataattgtgaaatatgagggtgaggggagagccaagaggagagccctaaggatgcagcatgaatctgcaactgcccccccc

SEQ ID NO: 465 - DNA, 434 bp, Trichoderma reesei
gcgtggtcgcggccgaggtacgagtctcaccagaaggagcttgagggtgtcgccaaccccatcatgatgaagttctacggagctggtggtgagggtggcatgcccggtggcatgcccggcggtgccggtggcttccctggcgctggcggcgctcctcaccagggtggcgatgacggccctaccgtcgaggaggtcgactaaatgcacaacaagcccttttgataccccaaacatcatcagacttgagcctcaagcttggtaacgcgtctacgatgtgtggaggcctactctaggggatccaaggccatgatgcatgattaaattctttcctttgttctcatttgctttttccgcactagcatttcacggatatgaagggtaaaaaagctgggcgggttggccctggttttgtacctgcccgggcggccgctcga

SEQ ID NO: 466 - DNA, 484 bp, Trichoderma reesei
gcgtggtcgcggccgaggtcaacttctcttcatattcacaatgggttggttcgacgacgactccgagcaggctcaggcctaccagcaggttaccgagcgacctcacgaagcccagtggtctcacgagctcatcggaggtgctgccgcttatgaggctgccaaggcctacgaggaccacgttgccgagaacggccaccccgacgaccacgccaaggccaaggagatcctcgccggtgtcattggtgccttcgtcgaccgcgaggttgagaccaagggccttgacttcatcgatcgtgagagggccaagcgccatgcacaggagcaggccgaggcacagctcagcaaccagtcgtcggtctcggaatcaagacctccaaggaagtcgccactgccatccgtgccgccatcatcatcgccaagctgagcgtcatccccgtccgaagaggctactggggctccaacctcggtctcctcactcctgcct

SEQ ID NO: 467 - DNA, 117 bp, Trichoderma reesei
ttcgagcggccgcccgggcaggtactggttgctgagctgtgcctcggcctgctcctgtgcatggcgcttggccctctcacgatcgatgaagtcaaggcacctcggccgcgaccacgc

SEQ ID NO: 468 - DNA, 561 bp, Trichoderma reesei
gcgtggtcgcggccgaggtactggttgctgagctgtgcctcggcctgctcctgtgcatggcgcttggccctctcacgatcgatgaagtcaaggcccttggtctcaacctcgcggtcgacgaaggcaccaatgacaccggcgaggatctccttggccttggcgtggtcgtcggggtggccgttctcggcaacgtggtcctcgtaggccttggcagcctcataagcggcagcacctccgatgagctcgtgagaccactgggcttcgtgaggtcgctcggtaacctgctggtaggcctgagcctgctcggagtcgtcgtcgaaccaacccattgtgaatatgaagagaagttgagacctgccccgggcggccgcccgggcaggtacctttcctttcacaccctctgctaagcttggtatggcttgggttaccaagtcataatacaggaaccgccaatcgccaatatgcgcgtttccctggccgtaagactcaactcagcgtggggttgtccagtcgatccattggctttgattggccgaaaagtcgctttggaaaatcgccgta

SEQ ID NO: 469 - DNA, 99 bp, Trichoderma reesei
gagcggccgcccgggcaggttgaagagtgggatatcagcaattgccatttctgacctggataggtttcctatggtcattcctataagagacacgctctt

SEQ ID NO: 470 - DNA, 506 bp, Trichoderma reesei
tcggagcggccgcccgggcaggtacagccaaagtcaaaacccgcgatgttaacgccggcaaatcggaccccagagctcgtgggtggagttgatgagcttgttgaggtagccctggtggtggtggttggaccggatggtggccgggtcgaagtggtgatagtagtggctcccggaatacattgcgcataataaggattgagggtcgaacaagctgagccaggagcacaattcgtaggtccgctccaaccaatacctccacactggccccagacagtctgctgtgcagcggcgccgccatatagtatggacgctgcaagcagcaatggagccacggacttgttcattgtcgatgacggggagatattatcgagcagaggcttcgtctgtgcgactgaataccaatctgatatctacgggccgacgaaagagcgtgtctcttataggaatgaccataggaaaacctatccaggtcagaaatggcaattgcacctcggccgcgaccacgc

SEQ ID NO: 471 - DNA, 369 bp, Trichoderma reesei
gaattcgccctttcgagcggccgcccgggcaggtacagttcgagcccgcgctgatcccgatgcaaccagtgaatgaatatgtgatgttgatgatgatgatagttgtaacgccagggtaacccgtatgatatgaataaccgatgatgatttccttttgtctttcccgtgggttgttgagaggtctaaagcgttgattcgtcgtagctgggtatggtaacgatggaaaaggaggcggcgttgatgatatagtgaaaaggtgccaaagagtaatcgatgggggtagatgatgatgttgatgaggtgatatagaggattgcgggtatagattgcatcaagcaaaagaggagacctcggccgcgaccacgctaa

SEQ ID NO: 472 - DNA, 349 bp, Trichoderma reesei
gcgtggtcgcggccgaggtgatgcaatctatacccgcaatcctctatatcacctcatcaacatcatcatctacccccatcgattactctttggcaccttttcactatatcatcaacgccgacctccttttccatcgttaccatacccagctacgacgaatcaacgctttagacctctcaacaacccacgggaaagacaaaaggaaatcatcatcggttattcatattcatacgggttacactggcgttacaactatcatcatcatcaacatcacatattcattcactggttgcatcgggatcagcgcgggctcgaactgtactggcccgggcggccgctcgaaagggcg

SEQ ID NO: 473 - DNA, 174 bp, Trichoderma reesei
gcgtggtcgcggccgaggtgcgacggaccctggtgttctcatcaacatctacaccagcccgctcaactacatcatccctggacctaccgtggtatcaggcctgccaacgagtgttgcccaggggagctccgccgcgacggccaccgccagcgccactgttcctggaggcggtag

SEQ ID NO: 474 - DNA, 472 bp, Trichoderma reesei
tcgagcggccgcccgggcaggtacagagtctgggttgggccgccagcaggtgccgacgtggttgcgggaggcgtagagctgggcctgcttgaggcctgcgtcgtcctcgccgttgtcgtggttctgctggtcgggccgctaccgcctccaggaacagtggcgctggcggtggccgtcgcggcggagctcccctgggcaacactcgttggcaggcctgataccacggtaggtccagggatgatgtagttgagcgggctggtgtagatgttgatgagaacaccagggccgtcgcgtgatagaggtcggtccctagaacgccgctgggctgcagagaacccgagcccgagacgcaatgttgaaacactggggtagttctgagcgccgtttgcctgccggggctgtgtaacgcgatgatctcgtggcggacacgtaattgcctgcgcaagattgtcggggatcttgacgacccagg

SEQ ID NO: 475 - DNA, 288 bp, Trichoderma reesei
cgagcggccgcccgggcaggtcgtcaccgttgccgtcctggtcgaccgaatgaagatcaacggctccctcgcccgccagtgcatccgcgacctcgaggagaagggcatgatcaagccggtcatcactcatagcaagatgaagatctacacccgtgccatcggcgagtaaatttaccaccatgtttgaaagttaaagcattgagatttggcgcctggttggtctgaacggaagaaaatgggccatgagagcagaggatgatacacgaggtacctcggccgcgaccacgc

SEQ ID NO: 476 - DNA, 262 bp, Trichoderma reesei
cgagcggccgcccgggcaggtgaatgaagatcaacggctccctcgcccgccagtgcatccgcgacctcgaggagaagggcatgatcaagccggtcatcactcatagcaagatgaagatctacacccgtgccatcggcgagtaaatttaccaccatgtttgaaagttaaagcattgagatttggcgcctggttggtctgaacggaagaaaatgggccatgagagcagaggatgatacacgaggtacctcggccgcgaccacgc

SEQ ID NO: 477 - DNA, 416 bp, Trichoderma reesei
cgagcggccgcccgggcaggtaccagccgctcctgcgccgacaaccgaatccatcgtaatagtagccgtatccgcagatgctatctcgagcgaagaggtccattactggcgccatgcctgctggataaataaagggaggatgccagagagagagagagagagagagagagagagaaaggtaagagttgcgtcgccgacctcgacaggtcgatggaatcagcaatagagaacccaagtgtcgtcgtcacttgttgtgaatgtaggtccggtcgctttgctgtggggatcgcctttcaatgattgtttgcgatgcacagcgatgcgcgatagtaggtagattgaaagagtggaagaaaaggggggagaaagatgaagagtaaaaggaagaagtgaggagacctcggccgcgaccacgc

SEQ ID NO: 478 - DNA, 505 bp, Trichoderma reesei
gagcggccgcccgggcaggtactgtgacagccagtgtccccgcgatctgaagttcatcaatggccaggccaacgttgagggctgggagccgtcatccaacaacgcgaacacgggcattggaggacacggaagctgctgctctgagatggatatctgggaggccaactccatctccgaggctcttaccccccacccttgcacgactgtcggccaggagatctgcgagggtgatgggtgcggcggaacttactccgataacagatatggcggcacttgcgatcccgatggctgcgactggaacccataccgcctgggcaacaccagcttctacggccctggctcagctttacctcgatacacaagaatgctgacataagggtacgacatcatgcatccatccacaagacgtcggggtgccatttgaccgatactatgtccagaatggcgtcactttccagcagcccaacgccgagcttggtagttactctggcaacgagctcaacga

SEQ ID NO: 479 - DNA, 513 bp, Trichoderma reesei
gcgtggtcgcggccgaggtcaactccatctccgaggctcttaccccccacccttgcacgactgtcggccaggagatctgcgagggtgatgggtgcggcggaacttactccgataacagatatggcggcacttgcgatcccgatggctgcgactggaacccataccgcctgggcaacaccagcttctacggccctggctcaagctttaccctcgataccaccaagaaattgaccgttgtcacccagttcgagacgtcgggtgccatcaaccgatactatgtccagaatggcgtcactttccagcagcccaacgccgagcttggtagttactctggcaacgagctcaacgatgattactgcacagctgaggaggcagaattcggcggatcctctttctcagacaagggcggcctgactcagttcaagaaggctacctctggcggcatggttctggtcatgagtctgtgggatgattactacgccaacatgctgtggctggactccacctacccga

SEQ ID NO: 480 - DNA, 191 bp, Trichoderma reesei
gcgtggtcgcggccgaggtaccacagatggcacttgcgttacctcgaaggtttatcctccgttgaagaacttcaccggctcaaacaactaccccgatggcatcggccagatgcagcacttcgtcaacgacgacgggatgactattttccgcttacctgtcggatggcagtacctgcccgggcggccgctcg

SEQ ID NO: 481 - DNA, 592 bp, Trichoderma reesei
tcgagcggccgcccgggcaggtgcaaagttgagcactctccggcttgcgagccttctttcccttgtcagtgtgcaggtatctgcctctgtccatctattggagagtctggagaagctgcctcatggatggaaagcagctgaaaccccgagcccttcgtctcaaatcgtcttgcaggttgctctgacgcagcagaacattgaccagcttgaatcgaggctcgcagctgtatccacacccacttctagcacctacggcaaatacttggatgtagacgagatcaacagcatcttcgctccaagtgatgctagcagttctgccgtcgagtcttggcttcagtcccacggagtgacgagttacaccaagcaaggcagcagcatttggtttcaaacaaacatctccactgcaaatgcgatgctcagcaccaatttccacacgtacctcggcgcgacacgctaagggcgattccagcacatgcgccgtatagacagtgacagtggttgtagatgagatagcagctcggaccagctgatgaagctggatcaaggcctatagtgcgacgctggtcgcattacgaatccagtcacgcataag

SEQ ID NO: 482 - DNA, 533 bp, Trichoderma reesei
gcgtggtcgcggccgaggtatgtcatgcctcgacgatctgcatgagcgatctatgaaatgccgtcaccaatcgctttttccttgttgatgccgtccgcatatggacgtgcattgacgcaacacactacacttgttgcaacaacacacaaatggaagacgaacaaagaaaaaaaaaagaaatctttctaccaaaacgcttcaaaaggagtctgatctgtgtgattgtgtaacacatgcacacatagatacgacctgccgtctcatcggtaggaggtgaaggaggaaacgagacgaaggaagatacgaggccttctgggtaggaaggaaaggggagaacggggggggagaaggagttgaccattttctttgacatggaaaaaaaagcacctgagggcggggaaaggacggcctgccctttcgtgtcttgtgtcttttctgaatgcatggcgttagaaggggtatagggagaacaacggggtcctgtgttttgttgcttcttgtcacttcctcctgttctttttctcgtggttcta

SEQ ID NO: 483 - DNA, 384 bp, Trichoderma reesei
gcgtggtcgcggccgaggtaagacgaacaaagaaaaaaaaagaaatctttctaccaaaacgcttcaaaaggagtctgatctgtgtgattgtgtaacacatgcacacatagatacgacctgccgtctcatcggtaggaggtgaaggaggaaacgagacgaaggaagatacgaggccttctgggtaggaaggaaaggggagaacggggggggagaaggagttgaccattttctttgacatggaaaaaagcacctgagggcggggaaaggacggcctgccctttcgggcttggtcttttctgaatgcatggcgttagaagggtatagggagacaacggggccctggttttgtgcttcttgcactcctcctgtctttttctcggggtc

SEQ ID NO: 484 - DNA, 542 bp, Trichoderma reesei
gcgtggtcgcggccgaggtacctggggcccagatcatcttggaactcttaaggcagatgctaaccgtgaggtcctccttgtaggacacaggcttggggatggcgtcctcgtccgactcggagtctccggagggcaagttgcgagtgaggacaactttctgcagcttggatcgagaaaccccttctgtaggctctactcggacgtaagaagagatgtaatactgccatttatcacgcgtctgcatctcgtccatgtagaaggtagtctcgtctcgctggagccatcgaaccgtagcttccgctttttgagggaaccagcaaatgacaaacaagtcgccatccttgacacatttctcggcgaatttccgggcactgatctctgtctgatagctcgtctcctccctctcccggttgatgaggtacctgcccgggcggccgctcgaaagggcgaattccagcacactggcggccgttactagtggatccgagctcggtaccaagcttgatgcatagcttgagtattctatagtggcactaatattg

SEQ ID NO: 485 - DNA, 553 bp, Trichoderma reesei
tcgagcggccgcccgggcaggtacacggcggaggagctggggatcccgacgctcaacatgattacgcccgtgggcgtctagaagcccaagggcaagaagaagggcaaggtgtttgtggacgacaaggagagcatgactactattctatcgcttgttcaagctgaaaaggaaggccacatcgaatcgaagatcatgaaggcccggcaaatggaggaaatccgtgaagccagaaggctggaggctgagaagaagtcagccgaaaagaaggcgaaattcgaggacaccaaggagtctctgcgcaagaagcgcaagagaaagaacgatagcgaaggcggcgataacctgaagagcatatcgcagacaggctcaaaagcggtcaaggggtccaagaagaaggtgtcattcgcatgatgcgcactaggcatgtaattgggaggggagaggggaggctatggaaatgtacctcggccgcgaccacgctaagggcgaattccagcacactggcggccgttactagtggacacgcactgtgttgttagctttcacgactgcg

SEQ ID NO: 486 - DNA, 273 bp, Trichoderma reesei
tctgggaacaaaatgttcaggggaaatttctcagtcgaagcctcgacacaaccatgtccagctacacgacacacaaaagcccgcatgtcacttacattccgaccttgacaggaggcatcggagctgacgagctcgaggaattctattcccaatattttgggaaccccaagtcactcaagctaactctagtgtctcgaaccattggtgccgaccgcatcgtcgatgagatccacgttcggttcaagcatacacaagagatgccttggatcttgc

SEQ ID NO: 487 - DNA, 354 bp, Trichoderma reesei
cgagcggccgcccgggcaggtactctcgaggccgctgcgcttcccacaacaggcagcttttcgattcctagtttctttgccgattccggtattgcattgggatctagggccccaatctgaagcaagacgctggcttggtcccagtagacgtgctcatgatacaatttcccacctctcatagtaacaatactaactacgagtatttggactcgcttttgggtggccgggacgcctggcaagatccaaggcatctcttgtgtatgcttgaaccgaacgtggatctcatcgacgatgcggtcggcaccaatggttcgagacactagagttagcttgagacctcggccgcgaccacgc

SEQ ID NO: 488 - DNA, 215 bp, Trichoderma reesei
gcgtggtcggggccgaggtacaagcttttttttttttttttttttttttttttgcaatgagcatcacatagagtattcatagctgctgacttttatctacccagcccagcgcaatgcacttcaactctctccacttcacttcacttcactccatgctcatccccttataagcactgggagtagtatgggttcaggacctgcccgggcggcgcctc

SEQ ID NO: 489 - DNA, 149 bp, Trichoderma reesei
cgagcggccgcccgggcaggtcttgggtggtttctgcattctcggacattttcgggcgaaaaaggactggttttggtagacggaggaaagccgctactgaagtgttgacgacaatgatttctatgatagtacctcggccgcgaccacgc

SEQ ID NO: 490 - DNA, 449 bp, Trichoderma reesei
gcgtggtcgcggccgaggtcgcggcctgaagcgccgccccatgggcctcatcaagaagctccgaaaggccaagcaggaggccaagcccaacgagaagcccgacctcgtcaagacccacctgcgagacatgattgtcgtccccgagatgattggcagcgtcatcggcatctactccggcaaggagttcaaccaggttgagatcaagcctgaaatggttggccactacctgggcgagttctccatctcatacaagcctgtcaagcacggtcgacctggtatcggtgccacgcactcttctcgtttcattcccctcaaataagaaggcgtgtggtcttgggtggtttctgcattctcggacatttcgggcgaaaaaggactggttttggtagacggaggaaagccgctactgaagttgttgacgacaatgatttctatgatagtacctgccc

SEQ ID NO: 491 - DNA, 200 bp, Trichoderma reesei
cgagcggccgcccgggcaggtacgactaggcaaccagcttgacagttacctgtttacattctctgaccttcttgacttgtagtatccaagactccatgcaacttacatgacaatgcccatcacataccaaagatcagtaatactgaccccttggcgttcccgtcctattgtacctcggccgacctcggccgcgaccacgc

SEQ ID NO: 492 - DNA, 414 bp, Trichoderma reesei
gcgtggtcgcggccgaggtacctttggaggtcttttggcatgcggtctcacgcacactgcggtaactcctctcgatttcgtcaagactcgccgccaggtcgactcaaaactctacaagagcaactttgaggcatggggaaagatttaccgcgctcagggcatccgcggcatcttcaccggctggagcccaaccttcttgggttactcggcccaaggcgccttcaaatatggatggtatgagtacgactaggcaaccagcttgacagttacctgtttgcattctctgaccttcttgacttgtagtatccaagactccatgcaacttacatgacaatgcccatcacataccaaagatcagtaatactgaccccttggcgttcccgtcctattgtacctgcccgggcggccgctcga

SEQ ID NO: 493 - DNA, 189 bp, Trichoderma reesei
tccagcggccgcccgggcaggtactcacggggacaatttcgcccacgtcgacaacaattactacagctgcgcaatctctacagcattctagcttcactctaggcgactacgctctgcatccacgatcgcttattcgcctacatttcccactcccctcctcccgccgccgacctgcccgggcggccgctc

SEQ ID NO: 494 - DNA, 396 bp, Trichoderma reesei
gcgtggtcgcggccgaggtacgtcagccactgggtgtcatcctccttagagtgggaaaacagcgcgcccagagagtaatagcccggaacgacgaagcccgcaaagtttgtgaggagctggccaccaatgttgaaaatgatgaggaagaagtagagagcggcgaagccgatgacggcatatgccttggggacgcccagctgcttctcgaggttgttcagggcggggtatttggagagctccttgtcaaggacgctcagataatcctgggcctttgcctgtgcggacgccatttcgacctagagtgaagctagaatgcgtagagattgcgcagctgtagtaattgttgcgacgtgggcgaaattgtccccgtgagtacctgcccaggcggccgctcga

SEQ ID NO: 495 - DNA, 403 bp, Trichoderma reesei
gcgtggtcgcggccgaggtttttaggctcaaaacttcataatggagcttaaagcactcagtgccgttgtgctgagctttgtaactcttgtcgcggcagcaccggcgacctgcacgcttccgtccacataccgctggaattcgaccggtgctttagccagcccgaaatcaggctgggtctcgctgaaagacttctcccatgtcatttataatggccagcatcttgtatggggctcgactcatgacacaggaacaatctggggttcaatgaactttggtctgttcagtgactggtccaatatggcaacggcaagccagaacaaaatgactcccggcactgttgctcctaccgtcttctactttgccccgaagaatatttgggtacctgcccgggcggcccgctcg

SEQ ID NO: 496 - DNA, 344 bp, Trichoderma reesei
cgagcggccgcccgggcgggtacttttcactatcgcttatgtatcatatttagcctttgaggaaggttccccataatatttaaacagttttaaaccgttttacttgttaggcttttctactttcgctcacgctattcatagaatctcttttgatttattttcctaaagttactaagatatttcaattcacttcgtttattacaaaatttctcttagagttcatataattataggataaatgtcctatatatataaataattctctttaatacatagcttaaattccataataggttctttatatacttatatatttataagtaatacctcggccgcgaccacgc

SEQ ID NO: 497 - DNA, 161 bp, Trichoderma reesei
gcgtggtcgcggccgaggtaccaaaataagagcttaggttacaaaaataaatgatatataactattacttataaatatataagtatataaggaaactattatgaatttaactattattaaagagaattatttatatatataggacatttatcctataatta

SEQ ID NO: 498 - DNA, 364 bp, Trichoderma reesei
tcgagcggccgcccgggcaggttgcagcagaaattattgagagaaatgctaccacacagctggaggccgcatgtctcagacgatgtagatgggggaatacgaagcggctgaggtataaggtagggcatgtgcaaccattttggctgaaactgctgggcacagacaatactctgtggcatgtcagtctttgtcgttctctggggttgagatatatatattgccaagaatgcatctacgatattcagtcggttggcctcgcaacatcgacggaaaacaaaatcaagttcactgcttccctcattgtgctcctcattggagtcgtcgttgcacatcctatacagcatcgccaggatagcgagtgtgc

SEQ ID NO: 499 - DNA, 519 bp, Trichoderma reesei
gcgtggtcgcggccgaggtgattctcgtatctgcagcagcaactattgagagaaatgctaccacacagctggaggccgcatgtctcagacgatgtagatgggggaatacgaagcggctgaggtataaggtagggcatgtgcaaccattttggctgaaactgctgggcacagacaatactctgtggcatgtcagtctttgtcgttctctggggttgagatatatatattgccaagaatgcatctacgatattcagtcggttggcctcgcattcactgcttccctcattgtgctcctcattggagtcgtcgttgcacatcctatacagcatcgccaggatagcgagtgtgccgtatacgacgagtgtttccaataccctctgccgtgcccgtcgaatcacatctcgaaacaagttgtgagtctcttgacatcgtctatgcttctggaggtgatgatgctgaggttgtacctgcccggcggccgctcgaaaggcgaattccagcacactggcggcgtactag

SEQ ID NO: 500 - DNA, 272 bp, Trichoderma reesei
gcgtggtcgcggccgaggtgttcggcctccgttcatgattctgatataagggggaaataccaagtgttgggatttatctatttttttggtttacgtcgacgggatggggggaagcgatattcaattttttgggatgtatagagaatgggttctcttgggttaacgggacatgcaagctcggtgttcaagggaactcgattttttttttgatcgcccgcaggaaaggatgcgctacacatctcgcttttgtgtgcggccgtttcccggggccg

SEQ ID NO: 501 - DNA, 131 bp, Trichoderma reesei
tcgagcggccgcccgggcaggtactgcaatgcgactattatgatgttgacgaggcgcgggttgtcgaacagaccaagtcctgctggggattctcgacgggttcagggacagatgctcggatgtgccggcag

SEQ ID NO: 502 - DNA, 321 bp, Trichoderma reesei
gcgtggtcgcggccgaggtacaagaagaacatggagtgagcgcagatagtctcagccgtgccagtgaagagatatgcctgggcgtagatcttgaagttgatgaggtggtcctttttgtggttccgaggaggcagcgacaggaggcaaactcttccttttccatgatgagcgagagggacaggaacagatcgggaagacgcagatgatgatcatgaggaacgagcttagaggcagggaacgccaaagaagacattgacgaggacgggtcagatctccgaccagctaccggcgtgaagaaggtacctgcccgggcgcccgctc

SEQ ID NO: 503 - DNA, 418 bp, Trichoderma reesei
gcgtggtcgcggccgaggtacgtggacgcgtaggcggcaccgtccagacagcagttcttcgcgcaggtctcgttgtcaggacatagggtcgagctccaagtgttgccatcgtagcagttcgtgctgctgttcgtagcgtgagtccagcgccagttggcgtcgatgaccacggagcctgtctgttgagtgtacgtgccaccagacgagcatttctgccatgtcagaggcgggtgagtctccgattggagagtgcaggccgactgagcacgagctgtggccaagaaggccgagatgacggccaacttccgatacatgatgcgcagtccgcggtgactattgggtttggctaaaggctccctagaccatggcgtttgcatgcactggtctatcatgcaactggacgcacgcggaacggccc

SEQ ID NO: 504 - DNA, 350 bp, Trichoderma reesei
cgagcggccgcccgggcaggtacatccacgctattggacctcttcttgccaatcacggctggtccaacgccttcttcatcactgatcaaggtcgatcgggaaagcagcctaccggacagcaacagtggggagactggtgcaatgtgatcggcaccggatttggtattcgcccatccgcaaacactggggactcgttgctggattcgtttgtctgggtcaagccaggcggcgagtgtgacggcaccagcgacagcagggcgccacgatttgactcccactgtgcgctcccagatgccttgcaaccggcgcctcaagctggtgcttggttccaagcctactttgtgcagctt

SEQ ID NO: 505 - DNA, 336 bp, Trichoderma reesei
gcggccgcccgggcaggtgcttgtaagatcaccctctgtgtattgcaccatgattgtcggcattctcaccacgctggctacgctggccacactcgcagctagtgtgcctctagaggagcggcaagcttgctcaagcgtctggggccaatgtggtggccagaattggtcgggtccgacttgctgtgcttccggaagcacatgcgtctactccaacgactattactcccagtgtcttcccggcgctgcaagctcaagctcgtccacgcgcgccgcgtcgacgacttctcgagtatcccccacaacatcccggtcgagctccgcgacgcctccacctgg

SEQ ID NO: 506 - DNA, 211 bp, Trichoderma reesei
gcgtggtcgcggccgaggtgctacgctggccacactcgcagctagtgtgcctctagaggagcggcaagcttgctcaagcgtctggggccaatgtggtggccagaattggtcgggtccgacttgctgtgcttccggaagcacatgcgtctactccaacgactattactccagtgtcttcccggcgctgcaagctcaagctcgtccacgcgcg

SEQ ID NO: 507 - DNA, 170 bp, Trichoderma reesei
gcgtggtcgcggccgaggtactttgatgccaactgcgaccaaaggctcgtgaattgagcattagtagggccgccctgaccaatgatcccaccgttccatcgagcataattgtggatgtcgacgatgcagtatgcgcccagagacaggcacctgcccgggcggccgctcga

SEQ ID NO: 508 - DNA, 283 bp, Trichoderma reesei
gcgtggtcgcggccgaggtgccgcggcggcggcaatcaacaactttcacaactcttgcccggacactcagctggtgttggtcggatactcgcagggtgctcaaatcttcgataatgccctctgcggaggaggcgatcctggtgaaggaattaccaacactgctgtccccctaactgcgggagcagtttccgctgttaaagcagcaatcttcatgggagaccctcgaaacattcatggcctgccctataacgtcggaacctgtacctgcccgggcggccgctca

SEQ ID NO: 509 - DNA, 543 bp, Trichoderma reesei
gcgtggtcgcggccgaggtacaagctttttttttttttttttttttttttttgcaggtaaatttttttgtctttcatttttgggcattcaggccagccacgcacacatctctatctgggtagggttggcattgactcgtggagaatacaaaaggaaatgtggtggccctcagagagtgcatttgttgacgtgccgagtgttgtaactagcttgaaatatcccacccatcgacctttgaacgcaacgacccatacatcaacccaaggatatccgatgttacgacggccgtgataaaacgcctagatggagggaggaggaggaggtgaccaggggctataaaacaaatcctgaatctttcgttgtgctcattgggttatgggagctaggatttgatttaaccctgcttgggagcctccttgcgctcgatggcggcctcctcacccatggaggtgaggacaacaacgtctgagtcaaaaagcagaacaagctccattgccagcaatgtgtgacatgtttggagattagaaaagccatgacttactg

SEQ ID NO: 510 - DNA, 311 bp, Trichoderma reesei
tcgagcggccgcccgggcaggtcatctttgcgccttcaaggtctttccactgcgacctctcttgacaccacgcgatatatccacaactctgagcccttgagctttgcataaactacacacaagatacccaacatgcctttcaccgcaagcgacatttgcaagatccttcttgccatcatcctgccgcccgtcggtgtcttcctcgagcgaggctgcggcgctgacttcctgatcaacatcctcctcacgatcctgggttacattcccggcatcatccacgctctgtacctcggccgcgaccacgctaaggg

SEQ ID NO: 511 - DNA, 315 bp, Trichoderma reesei
gcgtggtcgcggccgaggtcaagcaaccaccatctttgcgccttcaaggtctttccactgcgacctctcttgacaccacgcgatatatccacaactctgagcccttgagctttgcataaactacacacaagatacccaacatgcctttcaccgcaagcgacatttgcaagatccttcttgccatcatcctgccgcccgtcggtgtcttcctcgagcgaggctgcggcgctgacttcctgatcaacatcctcctcacgatcctgggttacattcccggcatcatccacgctctgtacctgcccgggcggccgctcg

SEQ ID NO: 512 - DNA, 195 bp, Trichoderma reesei
gagcggccgcccgggcaggtacaagcttttttttttttttttttttttttttggggttttttcctccaaatgctcagatttgaagaatgagtggtgctgtatctcaagtcacctcgataggagaaccccccaaaaacgccgacagttaaccaacgctgcgctctcaatgatgtgctctatggaaggggcgatggg

SEQ ID NO: 513 - DNA, 481 bp, Trichoderma reesei
gcgtggtcgcggccgaggtacgtcgcatataaagcccgtcacgcgcctaaaaatagctgctgccttggatcaagcacaaggcagtcaaggtgacgactgtgcaatgaacaaggcttctgttttcctccaaatgctcagatttgaggaatgagtggtgctgtatctcaagtcacctcgataggagaaccccccaaaacgccgacagtaaacaaacgctgcgctctcaatgatgtgctctatggaaggggcgatgggatacatgcttgagtgtggtcatcggctgactcgtgattcgtcactctgggctttgatcagaaacccatcggtatagcttgcttagctcccgcccatggtgccgcgaaatcggcagcctcaactgacagtaacgccgggccgctatctggtaagacgggagggtggtcgacgatggtagggcttgatgtgtctatggctgtacctgcccggcggccgctcgaagggc

SEQ ID NO: 514 - DNA, 147 bp, Trichoderma reesei
gcgtggtcgcggccgaggtactttaacggcaagaaggcttccaaggtatcaaccccgacgaggctgttgctttcggtgccgccgggggagggcgccatcctgtctggtgacaccacttccaagtccaccaacgagatcctgcttctc

SEQ ID NO: 515 - DNA, 264 bp, Trichoderma reesei
gcgtggtcgcggccgaggtttttttttttttttttttcggttcgtgaaatagacctcataagacggtcaagagtcgtattgaggcgtgccgcaatctaggcaacgccaaagtgtgctaacataagatattgatgaccactgcaaatggccaagttcccatatttgcctagaattcccaaaaacgccgagtcgtccaaccaatcataaaagtgccatcgtgaagaggaggtgcgtttactggccgccacacctgcccgggcggcc

SEQ ID NO: 516 - DNA, 323 bp, Trichoderma reesei
tcgagcggccgcccgggcaggttttttttttttttttttttttgaaatagacctcataagacggtcaagagtcgtattgaggcgtgccgcaatctaggcaacgccaaagtgtgctaacataagatattgatgaccactgcaaatggccaagttcccatatttgcctagaattcccaaaaacgccgagtcgtccaaccaatcataaaagtgccatcgtgaagaggaggtgcgtttactggcccccacggagacggagaaccaggtgcagagtgctctccttctggatgttgtagtcgctcagggtacctcggccgcgaccacgc

SEQ ID NO: 517 - DNA, 372 bp, Trichoderma reesei
cgagcggccgcccgggcaggtactttgcctggtcgctcatggacaactttgagtgggcggacggctacgtgacgaggtttggggttacgtatgtggattatgagaatgggcagaagcggttccccaagaagagcgcaaagagcttgaagccgctgtttgacgagctgattgcggcggcgtgatggaaaaagtttttgagttgatgatacctgcaaagggatgctgaagatgatgatgatgtatgaacacgaaagggatagtattatagcaagctaggataacctgatgcttcttcaaaggggaaattgatatataaacatccaaaaaaaaaaagaaaaaaaaaaaaaagcttgtcctcggccgcgaccacgc

SEQ ID NO: 518 - DNA, 370 bp, Trichoderma reesei
tcgagcggccgcccgggcaggtacgactttgttcttggagctcacaatgatcatcgccgtcgtgctagcatcaactacgaccaaaactaccaaactggcggacaagtcagctattcgccttccaacactggcttctcagtgaactggaacactcaagatgactttgttgtgggcgttggttggacgactggatcttctgcgtaggaggactcctcatcattctgcactttgaaagcatcttctgaccaaaagcttctcttagtcccatcaactttggcggctcttttagtgtcaacagcggaactggcctgctttccgtctatggctggagcaccaacccactggttgagtacctcggccgcgaccacgc

SEQ ID NO: 519 - DNA, 391 bp, Trichoderma reesei
gcgtggtcgcggccgaggtctcaggccaagaggttgtcgagacggctggatttgcccgtcaggtattgcctcaccttccacctctcgacactctcaatgccggcattttgctcagtggtggaggaactgggacgatatcaatgtcttttgcttcgattcgacgagctactgagcttacaatcatcggatccaaaggcagcttctccctaacggatggtcccgacggctccacgttgtcacttgatctcgctacgggagagaggaggtcagagactataagaagtaaaggcgtggagctggagattaaagcttttctagaggccataaaggctgggaaatcggagaagcgggctggtccggaggaagccctgaatgacttggcgatcataga

SEQ ID NO: 520 - DNA, 185 bp, Trichoderma reesei
gcgtggtcgcggccgaggtctcaggatttggcggcaccagcctcccgaagtaaaatggtatgagacgccatggcgaaaagttcctgagtgtcaaggaggctttttgctggatgttgttcatcaaacggccatgcttcgtttcatctcaggccaagaggttgtcgagacgcctggatttgcccgtc

SEQ ID NO: 521 - DNA, 436 bp, Trichoderma reesei
gagcggccgcccgggcaggtacgaccgtcctccaactgcttaccagcaaagatcaagcgctgctggtcaggcgggataccctccttgtcctgaatctttgacttgacgttgtcgatggtatcagatgattccacttccagggtaatcgtcttacccgtcagtgtcttgacaaagatctgcataccaccacggagacggaggaccaagtgcagggtgctctccttctgaatgttgtagtcgctcagagtgcggccgtcttccagctgcttaccagcgaaaatcaggcgctgctggtctggaggaataccctccttgtcctgaatcttggacttgacgttgtcgatagtatcagatgactcgacctccagggtgatggtctttcctgtgagggtcttgacgaaaatctgcataccaccgcgacctcggccgcgaccac

SEQ ID NO: 522 - DNA, 298 bp, Trichoderma reesei
gcgtggtcgcggccgaggtacgaccgtcttccaactgcttaccagcaaagatcaagcgctgctggtcaggcgggataccctccttgtcctgaatctttgacttgacgttgtcgatggtatcagatgattccacttccagggtaatcgtcttacccgtcagtgtcttgacaaagatctgcataccaccacggagacggaggaccaagtgcagggtgctctccttctgaatgttgtagtcgctcagagtgcggccgtcttccagctgcttaccagcgacctgcccgggcggccccctcga

SEQ ID NO: 523 - DNA, 465 bp, Trichoderma reesei
gcgtggtcgcggccgaggtctttgtcaagacactgacgggtaagacgattaccctggaagtggaatcatctgataccatcgacaacgtcaagtcaaagattcaggacaaggagggtatcccgcctgaccagcagcgcttgatctttgctggtaagcagttggaagacggtcgtctgatactatcgacaacgtcaagtccaagattcaggacaaggagggtattcctccagaccagcagcgcctgattttcgctggtaagcagctcgaagacggccgccctctgagcgactacaacattcagaacgagagcaccctgcacttggtcctccgtctccgtggtggtatgcagatgtttgtcaacacactgacgggtaagacgactaccctggaagtggaatcatctgataccatcgacaacgtcaagttcaaagattcaggacaagggagggtatcccgccctgacca

SEQ ID NO: 524 - DNA, 433 bp, Trichoderma reesei
gcgtggtcgcggccgaggtcgcattgaccacctccgcgtttctcctctgccttaccctacaataggtgcctttcaactgtagctctcgcagtttgttcatcgaaccagcaactgcacgcagttcaccgagggcaacaaaagaaagcttttcatacacataaaatcacaccaaaaatcgccatgaacccaaacgcaaggccgataaaacacatccagcgcgaggatctttacaccaacctcgaagttcgcattcaataccttcactcgttcctcgacttttcaagtcgtgacattgacgccctcatcagcgactccaaatacatcaaagccctcatccccgccgtcgtaaatattgtttacaagaaactcctccaatacgacattaccgcccgcgcattcaccacacgaagtacctggccgggcggccgctcga

SEQ ID NO: 525 - DNA, 361 bp, Trichoderma reesei
gcgtggtcgcggccgaggtacattacgactacactcgccttcacttgtcaaacatcgtccctaccatctggcacatgcgcaatagtgccgtcatacgcgacgcttattctcttcttctcaagacttgccttgacaggattcttcgcctggaacaggtcctcgatttcctccaagctccaatccctggtttcaacgaaaaagaagtagataacaatgacaccaaacgcgtcccaaaagacataaaggaaataatatttccagccagagttggcaatggcaatcggcggcacataagtgttcatgacctttacagcattgagcatgaatgctagaaacgccatgccctttgctcgggaattga

SEQ ID NO: 526 - DNA, 346 bp, Trichoderma reesei
gcgtggtcgcggccgaggtgactgtctggcacacagtttctctcgcatgagatttgccggtttccgtgaattacaaataactcacgcaagatgcatatccaatcgattcccatgtgggttgggagctccaacaactacgcctatcttgtggttgacgacaagtccaaggatgccgtcattattgacccggcaaacccgccagaggttgcgcctattctcaagaatgctctttctgcgggcaagatcaacctgacggccattgtcaacactcaccaccactgggaccatgccggcggcaacaagaaactgctatccgagctgggtacctgcccgggcggccgctcga

SEQ ID NO: 527 - DNA, 119 bp, Trichoderma reesei
gcgtggtcgcggccgaggtacaagcttttttttttttttttttttttttttttcagtgaaagatgagttgaccgtatatttgaaaagggtcagaagtagatacaaaaaaaataaatcac

SEQ ID NO: 528 - DNA, 324 bp, Trichoderma reesei
tgagcggccgcccgggcaggttctatttttgttatcttaaaatgcatggctactaaggaatcgttttgtgttttcgaaagccacaatttgccaagctgacaacatcgcaataccaagcaggccgcatctccagtgaaagatgagttgaccgtatatttgaaaagggtcagaagtagatacaaaaaaaataaatcacccggggccatgtagctcccgccgccgtcatgatacgggctcaccaagaatctatcggtgcgtcaggattttgccacggagctttacaggcactgagagtagtaagggttcaggacctggcaagttgtg

SEQ ID NO: 529 - DNA, 181 bp, Trichoderma reesei
tcgagcggccgcccgggcaggtggcacaacttgccaggtcctgaacccttactactctcagtgcctgtaaatcacccggggccatgtggctcccgccgccgtcatgatacgggctcaccaagaatctaccggtgcgtcaggctttcgccacggagctttacaggcactgagagtagtaagg

SEQ ID NO: 530 - DNA, 160 bp, Trichoderma reesei
cgagcggccgcccgggcaggtaccaccaccgagatcgtagacaatgatctggcgctcaccgtcggtcttgtccagaccataggcgatagcggcagcggtgggttcgttgacgattcggagaacgttcaagccggcaatggtacctcggccgcgaccacgc

SEQ ID NO: 531 - DNA, 208 bp, Trichoderma reesei
cgagcggccgcccgggcaggtctgagtttgattcctctgcgctcatgttgatgctcctcgtgggaggatgcgctgtcccgtcgacttgagcactgagtttgattcctctgcgcgtcttcgcacattcatgcacgtgttggatgtcttctaacaagtcactcgacttgagccaattctccagcaaccgttgccacatcttcagttttcc

SEQ ID NO: 532 - DNA, 208 bp, Trichoderma reesei; identical to SEQ ID NO: 531

SEQ ID NO: 533 - DNA, 488 bp, Trichoderma reesei
gatggatatcttgcagaattccgccctttagcggccgccccggggcagggtactgagggatttagtagggccacttgaaggagcaccgggttaatcaacattggagggagttcgaagaagaagcggggaccgtctcaaatccatctttgattgtaaggccccgtttgggaaaagtcttgccctcaatattcaaaagtcgaaagcccatcgaacagaagggtgggggagggccccgtagttgttgtcgttcaaaagggggcgagggcccccgtgttagcttcgccatttgtaaaggacccaaaagccattgtaaaggaatggtagccaaagtcggttgctgttcccgttgtctcccacaaagtatttgaagtcagaacgtttgtatacgcctccgatactcaaaataaccttgacacctttggaccctgcagtaaggaatgtctgactggagggacatgcaatggctcaagagcttcgagggccagccc

SEQ ID NO: 534 - DNA, 334 bp, Trichoderma reesei
gcgtggtcgcggccgaggtcggaggcgtatacaacgctctgacttccaactacttcgtgggagacaacggaacagcaaccgactttgctacattcctttacaatgcttttggtccttacaatgcgagctacacgggccctcgcccctttgacgacatcactacgggcctccccacctctgtcgatggcttcgactttgatattgaggcagactttcccaacgggccttacatcaagatgattgagacgttccgctctctcgactcctccatgctgataaccggtgctcctcagtgccctactaatcctcagtacctgcccgggcggccgctcga

SEQ ID NO: 535 - DNA, 534 bp, Trichoderma reesei
cgagcggccgcccgggcaggtacccgcttccagtgccgtggacgacgacgacctagactacctacaataacgacaaaacatacatacaaatagttaaagaagacagacatgagtaaaaagatcctttatatcgcgatcccttatcataaagctttttttcggacatacaaagcacgcaatgtcgcatgctctgttctcaagttccacatccattatgtccttcccccccgttttcactcgatgcctactttccgccccttgtgctctctcaccttctccgtcttcctacccctatcaatcgattcatacagattcttcttcctttcttcctctcatagccattgaggttgtgaaaaaaaggtcagtgcctggtcattcattatatgaaaggataagggtctaaaaaacactgctgctgtcttgatcagttcaatccacgatgacaatccaaacccggctgacttgatcctgggattgcatatgctgattacaagtatatcaagaagtagctctctcgaggcaagcttggagctc

SEQ ID NO: 536 - DNA, 394 bp, Trichoderma reesei
gcgtggtcgcggccgaggtgaaaaaaccaactgtttgaggacttcgggaagcatggcagcttttggggtttctttgtttcttttcttgcgcgctctgtctccgtcattttcttctttcggctggaggtgcgaaccagatggaactttgagtcagcttagtatcaacgtgtttgagtattctgtttgacttggaggccgcgatggcatgacttgaagcttgcctttttgttccacatgtttgcttgcctttttatttcacatgtttgcttatcctgcacgctcgggcgtgggcttggtttttcggtttgttcaccagtaaacaagaagatgtagatttgtgctgtagaatcagtaaagcaacgaatcgcattctgtgttgatgattttccattcg

SEQ ID NO: 537 - DNA, 394 bp, Trichoderma reesei; identical to SEQ ID NO: 536

SEQ ID NO: 538 - DNA, 670 bp, Trichoderma reesei
tcgagcggccgcccgggcaggtacaagcccgggttgttgaaaagaaacctcaagtagcaaagacattgctatactttgaactccagtccttttccatccctttcctctccctccctttttttgtttgcgtttttttgttttcggtttccattcggcggcacaaccacccttccctctccaatccaaaatttgacgaaagggccaccaggccacaggatgcatccccatcgcgcgattctccggacaaatattttaatatacacaaggagagtggaaatgcatatgcgaagaatgcaaaagttgcattcaggacacaagagtatttccattccctccaaagacttgagagagagagccaccggtcgttagcccctttatcccccgtctgggatgatcccctatcgcttcacagtccattgaaagggaagggaacttgtccataaatccttttctttgatctttttcattttttttattctttcattgcttccgattctccccccgtacgggagaaaatccgcgaaacgatatcgtcatcagggaagagcggtggtctttttcctcgtgctaatcagacaagtcgggtttgagacggcgagataattcaacccgcctatagtggccagcggtcctactacattagttgtacctcggccgcgaccacgctaaa

SEQ ID NO: 539 - DNA, 670 bp, Trichoderma reesei; identical to SEQ ID NO: 538

SEQ ID NO: 540 - DNA, 408 bp, Trichoderma reesei
gcgtggtcgcggccgaggtgtcctgcttctgcttcttcttcttcttctctttccctcgccgccgctgccatctctgtcgttatcgagtcgtttgttcgagctccttctccctcccccggtctctcgcttctggatccgcaattcactctcctgcgcctgccggtcgtttttacataatctgtctctcacagcatcattggtctaccccctcatcacgaagcgcgtcttctccctcgacatattatcacatacaacagtcaagatggtgtccctcaagtcacttctggtcaccgccaccatggttgccgtctcgatagctaaggactactacatcgatcccgacagtgttcctttgtcgacaagacagaactggtgcaactcggagacgtcgacgtgccccatcatctg

SEQ ID NO: 541 - DNA, 172 bp, Trichoderma reesei
ggccgcccgggcaggtctctgtcgttatcgagtcgtttgttcgagctccttctccctcccccggtctctcgcttctggatccgcaattcactctcctgcgcctgccggtcgtttttgcataatctgtctctcacagcatcattggtctaccccctcatcacgaagcgcgtct

SEQ ID NO: 542 - DNA, 387 bp, Trichoderma reesei
cgagcggccgcccgggcaggtacccctggatctagccttgccacagggctgggccagggatggtgtagctcgtgattgttgtgtaagggttgaacaagatgccagggtcagtgggcttgtagagctgagttgcaggagttccggcagggagcgctttcgtgcccgagcctgtgacggcgatgttcacgcactgaggatagttctgcatgccgttcgcactagaggcaccatgggcagcaagaagttcatggcggaagacatagtttccgggcccgaggctcgacgggatcttcacagtccacttgttgccctggttgatcagatcctgctgcgcccagacttgggtgttatagttgatgccggcctcctgaatcttgacccagcgca

SEQ ID NO: 543 - DNA, 387 bp, Trichoderma reesei
gcgtggtcgcggccgaggtacgcaatcgtgctcgcgccattcttgaccgaggcagcatcagtaaagtcgatcttgatggcgccaacagaggcgccaaggagcgcaacagccagtgcggcccgctgcatcgtgaatccgaaggtgatggtattcacacagagactcaatgactggacgaggccgaccagagagattgaagccgaggaaccgacttctctgcgtcagataatctccaaaaactgtgaaccccaaaggcaaaaaaaaataaaaaaactttttgacaactcgcaacacacagcaagaagccagcaaccaaaagcgagtgaaatggatagcccagcaacttgatcaaacgaaagacaggctgcgtcactcaagagacctgcc

SEQ ID NO: 544 - DNA, 434 bp, Trichoderma reesei
gcgtggtcgcggccgaggtaataaattcaaaagattgaggctcgttctggctcgcgctctgagtgacgcagcctgtctttcgttttatcaagttgctggctatccatttcactcgcttttggttgctggcttcttgctgtgtgttgcgacttgtccttcgtttttttatttttttttgcctttggggttcacagtttttggagattatctgacgcagagaagtcggttcctcggcttcaatctctctggtcggcctcgtccagtcattgagtctctgtgtgaataccatcaccttcggattcacgatgcagcgggccgcactggctgttgcgctccttggcgcctctgttggcgccatcaagatcgactttactgatgctgcctcggtcaagaatggcgcgagcacgattgcgtacctgcccgggcggccgctc

SEQ ID NO: 545 - DNA, 194 bp, Trichoderma reesei
gagcggccgcccgggcaggtccgcattggtgcaacaagcgacgtcgagaacgtctatgtgaccgcatatgtcaacaagaatggaaccgttgctattcccgtcatcaacgccgctcactttccttacgaccttacaatcgatctggagggtatcaagaagaggaagctgagcgagtacctcggccgcgaccacgc

SEQ ID NO: 546 - DNA, 260 bp, Trichoderma reesei
gcgtggtcgcggccgaggtactatttaaccctcttttcaaggtgcttttcatctttcgatcactctacttgtgcgctatcggtctctggccaatatttagctttagaagacatatacctcccattttgagcagcattcccaaactactcgactcgtcgaaggagctttacagaggctcggcggccagccagacggggctctcaccctctgtggcgtcccgttccagggaactcgggcgacctgcccgggcggccgctcga

SEQ ID NO: 547 - DNA, 167 bp, Trichoderma reesei
gcgtggtcgcggccgaggtacgagtgcctcaacatcctgcatcaaatcgccggctccatgtgcatcatcttcgtcatcatccacgcctcgtgctactcatcctactttggccttgccggtcgaatcgggatactccgggaagagagcgtgaatctatggcgagattg

SEQ ID NO: 548 - DNA, 333 bp, Trichoderma reesei
gcgtggtcgcggccgaggttttagatattaaacacataactattctaaataatagctagaaaatattagaagagcttgcgccttcataatactttcaattatctctaatttctatatagtgaaaatcttacctaatcttaaatatatatacataaaatgcaaatatatttaattttatatgattaaaaatagttaaactactcaaaatagcaaacaaaataattataaatttttagacactcctgtttactctttacagggtctgtgccccacataaactgtcccctagcgatagttccttaccaaagggtacctgcccgggcggccgctcga

SEQ ID NO: 549 - DNA, 317 bp, Trichoderma reesei
gcgtggtcgcggccgaggtaccctttggtaaggaactatcgctaggggacagtttatgtggggcacagaccctgtaaagagtaaacaggagtgtctaaaaatttataattattttgtttgctattttgagtagtttaactatttttaatcatataaaattaaatatatttgcattttatgtatatatatttaagattaggtaagattttcactatatagaaattagagataattgaaagtattatgaaggcgcaagctcttctaatattttctagctattatttagcaatagttacgtgtttaatatttacctgccc

SEQ ID NO: 550 - DNA, 278 bp, Trichoderma reesei
tcgagcggccgcccgggcaggtacttccttatggtcaaatgtcactatgaggggctacagttattactaatttaattagtgctataccttgaataggacaagatatagttgagttcgtttgaggaggtttaaaaacagttgaaccacattacggtgacgtaatgttaaaaatcctgcttaatgctggaaaatccccaaatttaggatttgcatacgatttattatttattcttttaatatctataatatacgtgaaaattgcaatgacagggggacaa

SEQ ID NO: 551 - DNA, 382 bp, Trichoderma reesei
gcgtggtcgcggccgaggtacttccttatggtcaaatgtcactatgaggggctacagttattactaatttaattagtgctataccttgaataggacaagatatagttgagttcgtttgaggaggtttaaaaacagttgaaccacattacggtgacgtaatgttaaaaatcctgcttaatgctggaaaatccccaaatttaggatttgcatacgatttattatttattcttttaatatctataatatacgtgaaaattgcaatgacagggggacaatcagcacgggtgagaagtttacatacttcagaagcctctcagagactacatgcaggagatctcacatatgcctatttagtaggtttgtttgaaggtgatggatattt

SEQ ID NO: 552 - DNA, 297 bp, Trichoderma reesei
tcgagcggccgcccgggcaggtactccaaagtgtgccaatgctcagtcagcctaccttgagtgcatcaactacgccgtcacacagctgaaccttccaaatgttgcgatgtatttggacgctggccatgcaggatggcttggctggccggcaaaccaagacccgaccgctcagctatttgcaaatgtttacaagaatgcatcgtctccgagagctcttcgctgattggcaaccaatgtcgccaactacaacgggtggaacattaccagccccccatcgtacctcggccgcgaccacgc

SEQ ID NO: 553 - DNA, 171 bp, Trichoderma reesei
tcgagcggccgcccgggcaggtacgatggggggctggtaatgttccacccgttgtagttggcgacattggttgccaatccgcgaagagctctcggagacgatgcattcttgtaaacatttgcaaatagctgagcggccgggtcttggtttgcacctcggccgcgaccacgc

SEQ ID NO: 554 - DNA, 171 bp, Trichoderma reesei
gcggccgcccgggcaggtatcgacgagaagaccgccgagctggtgtccaagggcagatggatggtgcctggttacaaggagaagtttggcgaccttgccatggtctaagaagttttgttttatatcacacccctttcgacatccctttgtgtacctcggccgcgaccacgc

SEQ ID NO: 555 - DNA, 314 bp, Trichoderma reesei
gcgtggtcgcggccgaggtacacaaagggatgtcgaaaggggtgtgatataaaacaaaacttcttagaccatggcaaggtcgccaaacttctccttgtaaccaggcaccatccatctgcccttggacaccagctcggcggtcttctcgtcgatggacttctcggcagcggcaacctcatcaacggtaagctcgtcgaatggccgggcctcctcgatgttcttgagcgtggcagtgaggtccttgagctccaggtcgacggcctgcttggtggcctctgcgttcttgacggccacctgcccgggcggccgctcga

SEQ ID NO: 556 - DNA, 450 bp, Trichoderma reesei
tcgagcggccgcccgggcaggtaccaaaatcggcaagacaatgacgaccgcttcaatgtcgctacgtttgagcaaatcatcgagcgtgtgcccaggagtgtcttcggagtaaaggtcaagattaccgataccaagcttcgttgcctccgccacaagagtagacgcggtagctttcgaacgagaataaaccgccttgacattggccttgttcagcacaagagcgggcaggtgttctacaagggagtcagtgtcaagaacgtatgttattcaagcaatgtgagagagttaactgccctcggtggcaaaaatgccagctcccaagattgcaataccagccatcacgccgagtttaagaggcgtttattcagtttggctagagagatgcgcctgatttgagacaactatacgaaacaacaatgtatcaaggtaagacctcggccgcgaccacgc

SEQ ID NO: 557 - DNA, 149 bp, Trichoderma reesei
ccctttcgagcggccgcccgggcaggtccgagcccagttcataatacagtagttgagttcatagcaacttcactctctagctgaacaaagtatctgcgcaaacatggttcgccggactgctctgtggcccttgggcttctctcaacgct

SEQ ID NO: 558 - DNA, 301 bp, Trichoderma reesei
gcgtggtcgcggccgaggtaccagccagcaacgttggggaagtgaccagtattctgcttctgatagtagtaatcgagaatgaaaccctgattgtattgtccattgatcgtgaagttttggacttgtccatggccgacagctcagcttccgacactccatatttttccaatagtgtatacacgagctcgttaccgtgtcagctcattttcccccgcagagcatccacctccctctgcagcgactcgagatcggccaaaatgtccacagtctgaccggtgtacctgcccgggcggccgctcga

SEQ ID NO: 559 - DNA, 318 bp, Trichoderma reesei
tcgagcggccgcccgggcaggtacatttccgtgcggaactcgcccaggaccagcggaactgttactgtgcagaaccacttcaatgcttgggcctcgcttggactgcaccttgggcagatgaactaccaggttgtcgctgtcgaaggctggggtggtagtggttctgcctcacagagtgtcagcaactaggttctgttgatgttgacttggagtggatggggggtttgagctggtatgtagtattggggtggttagtgagttaacttgacagactgcactttggcaacagagccgacgattaagagattgctgtcatgt

SEQ ID NO: 560 - DNA, 344 bp, Trichoderma reesei
tcgagcggccgcccgggcaggttgtacaagctttttttttttttttttttttttttttttggtgccaaagtgcagtctgtcaagttaactcactaaccaccccaatactacataccagctcaaacccctcatccactccaagtcaacatcaacagaacctagttgctgacactctgtgaggcagaaccactaccaccccagccttcgacagcgacaacctggtagttcatctgcccaaggtgcaggccaagcgaggcccaagcattgaagtggttctgcacagtaacagttccgctggtcctgggcgagttccgcacggaaatgtacctcggccgcgaccacgc

SEQ ID NO: 561 - DNA, 409 bp, Trichoderma reesei
tcgagcggccgcccgggcaggtcgatggttagcttctcctctcttgtcgttgccttggttggtatcgccagctcatgggccctttggaggaatccatcaacgcaaacataactgaacgcggacccaacaactttgttctgggaggacacaatgctgtccgtcgtgcggccataaactacaaccaagactacaccaccggcggagatgttgtttacacgcactcgaacaccggctttgcagtcaactggtcttatcccaatgactttgtcgtgggcgtgggctggaaccctggtggatctgctcccatcaatttcagcggcaactttggcgtcggcagtggcgtcggcctgctctctgtctacggctggagcactaacccccttgtcgagtacctcggccgcgaccacgc

SEQ ID NO: 562 - DNA, 412 bp, Trichoderma reesei
gcgtggtcgcggccgaggtttcacgatggttagcttctcctctcttgtcgttgccttggttggtatcgccagctcatgggccctttggaggaatccatcaacgcaaacataactgaacgcggacccaacaactttgttctgggaggacacaatgctgtccgtcgtgcggccataaactacaaccaagactacaccaccggcggagatgttgtttacacgcactcgaacaccggctttgcagtcaactggtcttatcccaatgactttgtcgtgggcgtgggctggaaccctggtggatctgctcccatcaatttcagcggcaactttggcgtcggcagtggcgtcggcctgctctctgtctacggctggagcactaacccccttgtcgagtacctgcccgggcggccgctcg

SEQ ID NO: 563 - DNA, 521 bp, Trichoderma reesei
gcgtggtcgcggccgaggtactcgacaagggggttagtgctccagccgtagacagagagcaggccgacgccactgccgacgccaaagttgccgctgaaattgatgggactacaaacatcgaacatatcagtatacaatgatgcaaagggggggagaagcaaatggtctcctacgcagatccaccagggttccagcccacgcccacgacaaagtcattgggataagaccagttgactgcaaagccggtgttcgagtgcgtgtaaacaacatctccgccggtggtgtagtcttggttgtagtttatggccgcacgacggacagcattgtgtcctcccagaacaaagttgttgggtccgcgttcagttatgtttgcgttgatggattcctccaaagggcccatgagctggcgataccaaccaaggcaacgacaagagaggagaagctaacacctgcccgggcgggcgctcaagggcgaggtccaattcctgacactggcggtcgttactagtggatccgatgca

SEQ ID NO: 564 - DNA, 163 bp, Trichoderma reesei
gcggccgcccgggcaggtgaagggcggctgagcccggatgacgatgatgtaacgctgcgcatgcgaccatacccctgatgtcgtggcatgatatttgtcctgtaaacaattagtttctctttctattatacaagataccacgggggccttgagcacccaacgg

SEQ ID NO: 565 - DNA, 340 bp, Trichoderma reesei
cgagcggccgcccgggcaggtactttaagcggagctacctgctgaagaatctcggcaaggaggctgatgtcaagatggagggatagacggtgtctattactgttgacgcctttcgcaaaagaaggcacctaaacgagagtcttcatggcaacacagacggccctgcatacagttatgagctacgtgaagcattgattcaaacacaacacggagacagcataggcgatgaagcaaaaggcgttttagcaggccgtatcaggatatcagccataggagggacactgtcgacattgcgtcaaagctaggtttgcatcacgatgtacctcggccgcgaccacgc

SEQ ID NO: 566 - DNA, 142 bp, Trichoderma reesei
gcgtggtcgcggccgaggtacgagagaacctgtcccgcagagaggcggggttcaacattctccttgacgatgtatctctgacgcacctcgccttttcgccagagttcacagctgctgtcgaagccaagcaggtcgcccaaca

SEQ ID NO: 567 - DNA, 195 bp, Trichoderma reesei
gcgtggtcgcggccgaggtgtggtataactatggttttaacagatagaaactttaatacttcattctttgaagtagctggtggaggtgatcctatattattccaacatcttttctgattcttcgggcatcctgaagtttacattttaattatacctggtttcggtataattagtacctgcccgggcggccgctcg

SEQ ID NO: 568 - DNA, 204 bp, Trichoderma reesei
agcggccgcccgggcaggtcaccaacgtcatccccgtctcccaggctcaggctcccgagcgtggccagcgacgattcggcgaccgccttcgccgcgactaaaaagctttttcacttttttttgtgggatattgggtctctggttttgcaacattttgcaggttggcgtctcaggatggtagtgagacctcggccgcgaccacgc

SEQ ID NO: 569 - DNA, 260 bp, Trichoderma reesei
cccgggcaggtaccgggcgaggatgacattgacgatggcgttgcagaggaacagcatgaagtagacgctgaacatgcggttctgcaggtcagtggggctggttccaagctggtagaaagtgaatccaacaaaaacgcgctgagaatgtgaacccagatctttgaatagatgtatggcgtgttgcgccactggttcaaaagcattcgcttcgtcagcagataagtctgcgtcaagatggatgcgttgtacctcggccgcga

SEQ ID NO: 570 - DNA, 432 bp, Trichoderma reesei
gcgtggtcgcggccgaggtactttgttcttctctcggaatttcagctcttcctaccaccccatgatttgccggcgaagcagcattacgtgtctgggaaacaatcctaacctgaccaagctcttgaccttggctccttggctcagaagctcgagccccggtctgcctcttggagcgctcacttactcaacctgtcctctttgataatgtcggcagccttctctgcaacgacataaaccatactctggatattccccgcaatgtgaactggaaagacactggcatcaaccactctcaggcccttggtgccatatactctcaatctactgtcaacgacacctcctgtctcccttggcttcatcgccaagctacagcacggatggaagcagcaaacctgactttgccgaacaacctctctcgcatgatctggggta

SEQ ID NO: 571 - DNA, 145 bp, Trichoderma reesei
cgggcaggtcaacacctcatcaatctctcttaaccaaccaccaaactacagccacccaccatgtccgcccaagactactacgccagcgcctccggaggaagcagcaacggttatcctcctcagcagcaatacggccagcagcagc

SEQ ID NO: 572 - DNA, 169 bp, Trichoderma reesei
gcgtggtcgcggccgaggtacacatgacatggtaagcaaaggacggccctcggaatccataaccgcctggattctgtgaactcggccttcgtagcttcagaaagccaaactagtagtaagaataagaatgtggtttgatttcgactgtacctgcccgggcggccgctcg

SEQ ID NO: 573 - DNA, 275 bp, Trichoderma reesei
gcgtggtcgcggccgaggtaccttcatctcatgggcttcatctaccgagatctgaagccggagaatatcctgcttcaccaatccggacacatcatgttgtccgactttgacttgtccaagcagtctggcccaggaggcaagcccaccatgattgtcggcaagaatggagccaggacagactctctgccgaccattgacacgcggtcatgcattgccgacttcaggacgaattcgtttgtcggcaccgaagagtacctgcccgggcggccgctcga

SEQ ID NO: 574 - DNA, 187 bp, Trichoderma reesei
gcgtggtcgcggccgaggtccctgacaccgctccgtccagaagtatacgtggtcctttatatgaaccagcgcaacgtgattgaaaagaggaaaaataattgtctttcgaggttagatgttttgtatttttggggacgcccgctgaggcgtcaaatggttggatcattcgtctggacatctttgcgtc

SEQ ID NO: 575 - DNA, 188 bp, Trichoderma reesei
gagcggccgccgggcaggtacaagctttttttttttttttttttttttttttttttttttatcaagattgaattgaaactatacagtaacgatttgttccgcctagacgaaaatcttattcaacatacttcttgacagaaagttactcctttcccccaaactgttcgtccacgcttcccattcttttc

SEQ ID NO: 576 - DNA, 304 bp, Trichoderma reesei
gcgtggtcgcggccgaggtgttctttatttttttttttttttttttttggtagtggttgtgatgtttgaagatgaaacgatgctggtctatgtgtatatccaaaggagtgggcaatcgtcttcgactgtatggtttggcacgaggtccgaggccgaatgagcggttggcgactgaatgcgcgagggagtgagtgtcttggtttatagggtcgcgaaaaggaacgtgttggcaacgtcgcaaaggaacgctggcagtggtcttgtcttaaggaatgactgaagacctgcccgggcgggcgctcga

SEQ ID NO: 577 - DNA, 153 bp, Trichoderma reesei
aaaacatctcgtcggggccatcgggggttgcggtcacagtggatgcttgctccagaacctgggcaacgaccgacaggtaggtctcaaagtgaccaccaatagcgccagcaatatctccaaagcactgaaggatagcaggcttgaactggttgg

SEQ ID NO: 578 - DNA, 205 bp, Trichoderma reesei
cgtcttgggcttcttgccctccttgtcgtagacggcccgaatctccttgatggcacctgttgtttcgtccttggtgaaagacacagccttgatggggtgaggaacgttcaggaggccgacgtcttgcccggagccagacggaagagtccttgctgtccacctcgcggaagtctgagcggtcaatgtacctcggccgcgaccacgc

SEQ ID NO: 579 - DNA, 494 bp, Trichoderma reesei
gcgtggtcgcggccgaggtaccagagaaacaacaagaagaacaaggaaatggagaagagaatgtcgcaagccgctagcttctgtgccgaagaaagagtccccgcccggttgaagaaaacagatccagaattgccgcctcagatccagccgtgttggtggtatcgtgtaaaggaaatgaacaagtagcccaaaacagaaggccgagcttgcgcccatgacgagacggatgatcaagttttctggactgtcaacgagaactagattcgaaaccatgtgcacgcttgctgtgtcgccgagagcagattgaaaagccagaacgagatgaaagatgaaagagaaaaagcaaaggaaaagtaggaaatgattaagggtatttccttggaaaagaaaaagaaggatattgtcgaggtattgggactccggtcctgatgcaacaaaacgcctatatgcctttgacatggggtgttctatgccgatgagaagtgatgactctt

SEQ ID NO: 580 - DNA, 400 bp, Trichoderma reesei
gcggccgcccgggcaggtacaagctttttttttttttttttttttttttttggcgacgacgtgattttctagggtgcccatggtcggtcctaaccaaggacccgacagcttctgcttctgctttgattgctttgtttgcttttccgtttactattaatgatgggggtctctgttgttcctgtaattgtagaggatacaaaatcccttgacccatggaagtttttcaccaaatacaacgcccttatataatctgggatagtagttattggcgctggtaagtgaccttgatcattttgtctccagactcatgccagcagtgttctccttggctgtaatagcaccttgctcattctcatattcaacgaagcaattccacgccgacctggaaccagtctgattt

SEQ ID NO: 581 - DNA, 155 bp, Trichoderma reesei
tcgagcggccgcccgggcaggtacgccgaaccaacgactgctgctactactactattactgcatcgatcatgtcgtatcagggatatggccagccctacggccaaccgccgccccctccccagggctacaaccagtacctcggccgcgaccacgc

SEQ ID NO: 582 - DNA, 128 bp, Trichoderma reesei
gcgtggtcgcggccgaggtacaaagatgtaaaccccgagaactccatattcccattagggccaggtgttcgtagcgccagtgacggaaaacccgaggagagaaagtacctgcccgggcggccgctcga

SEQ ID NO: 583 - DNA, 307 bp, Trichoderma reesei
gcgtggtcgcggccgaggtacaacaagtcgtgagcggtagaccactggtgttcaggaaaccacttccccgtgtgggggtcgatagatggattttgggacatagacgtggtaagcgggtgaaatggatcattcctcggatcgatcctcaaatgcggccctgcagcttcaatgtcttgattctcctcctgagggcgaggccgtgacggggcgggcgttggagttggtagtggcggaggagatgaaggtcgttgccccgaagcatcaaaaggatcagtcgagccacctgcccgggcggccggtaagggga

SEQ ID NO: 584 - DNA, 183 bp, Trichoderma reesei
gcgtggtcgcggccgaggtacacccccccgagagaagattccatatgaaataatgcgcttgggtgcgcgttgagtttctcgcgtcttacaacttggacttggtctgggccttcttcaggatgggctccatcttggtgggccttcatgacgtcgccccttgaccttgagcttgccggacatgaa

SEQ ID NO: 585 - DNA, 433 bp, Trichoderma reesei
tgagcggccgccgggcaggtacaagctttttttttttttttttttttttttttttaagataaaagaggcgcccatgacagcctggggcgattccattgtaaattagcaaaaggtgcgggtatgtatagcaggctatatgtgcaatgcaagaaaaccgaggagagagagagagagagagagagagaaagcccaagagatcaataaccaaaaccaacgtgacagacgtctgtgtatccaatgccctgtcttcttcccaacagaccgataccatcctatccatctgtaagaaacccccttgattacagtaggaaaggaaattccaagaattcgactgtgtcgggattccaaacgccagaccccatgtatatgaatgaaacaacctgaacaagaacgatagagtcaagtctatcagcccctggataatagtcgacgg

SEQ ID NO: 586 - DNA, 61 bp, Trichoderma reesei
cgaggtacattcgtcgaacgcatcaaggatacagactatttcgcctgcgttttgctgctgg

SEQ ID NO: 587 - DNA, 163 bp, Trichoderma reesei
cgagcggccgcccgggcaggtagctggactacaaggtgtcccagatcaaggaaaaggtcgaggagaaggagggcatcccgcccgtgcaacagcgcctcatccacggcggcaagcaaatgaccgacgacaagaccgcggccgagtacctcggccgccaccacgc

SEQ ID NO: 588 - DNA, 170 bp, Trichoderma reesei
ggccgcccgggcaggtaccgtatcacagctggaaacaccatgatctgatggtcttcatctgatcttgatccctttacggcccgttacccgataactttagaaagcccatgcaaaagtccattccttgctcaaagcctcgttcttcttccctgcttcgcggccacctcggc

SEQ ID NO: 589 - DNA, 50 bp, Trichoderma reesei
gcgtggtcgcggccgaggtacattcgtcgaacgcatcaaggatacagact

SEQ ID NO: 590 - DNA, 366 bp, Trichoderma reesei
gcgtggtcgcggccgaggtacagaagacgaatgatcttgcgtgtttattctgtttgcatagcgacggttgcggattaccatttattcgattaatgctccatgataatgcctagcacgcctaccagttcgacgaacctctttcgactttgagtaggcgatcaacgatgccttatcaaaggattggtttgctccatgaccatgttcttccgaaaaacacaaagagcacatactgggcgattcagtctgaattgccgagcttcctctcaaacgcatacttcaactctacttcgtcggcaacttggagtcaatcgcgtataatatcagtccgaataggactcggtgaccttcgctcacttactagaagcg

SEQ ID NO: 591 - DNA, 67 bp, Trichoderma reesei
gcgtggtcgcggccgaggtactattacatccccgagacgacacggacatgcagcgacgggcggcggt

SEQ ID NO: 592 - DNA, 354 bp, Trichoderma reesei
gcggccgcccgggcaggtccaaggcggcgtgtgaggtggtggtgatgatggtggtgacgatgagtcatgaagaaggaaaaaacaaaaacaaaaacaaaagaagaacaagcatgttgaagaaaaggacgacgacgaactgagacggagcgtggaagactgcaaatggggggcgtcacatggtaaactaaggcaggtgcttggaactgggaaaagatctgatgtaatgactggcttacatttacactgacgggagaggggggggggaaaggttgatgatgatatatcgtggagcgaacctgaaggcgagatcaagcaaaggtttcctccactcgtgtacctcggccgcgaccacgc

SEQ ID NO: 593 - DNA, 329 bp, Trichoderma reesei
gcgtggtcgcggccgaggtacttcggctcacgaatcaatatatcgcttatccctcttgcgtggcccaagactccaggttctgatctcagattgcagcacttgctgctagctgcgatcctctctggatgcacctgtcattctcatcagtccgttcccgaggaaaggaagcggcgcgttcgatcactgcgtgcaaattcctaagcatcttcgggtgattctagaggaaagcttccatattccatataccgctgccaccacaggacatctcggcttttgtgcagaagattacgtttcatatgccgtcggtacctgcccgggcggccgctcga

SEQ ID NO: 594 - DNA, 500 bp, Trichoderma reesei
gcgtggtcgcggccgaggtacttcgcattgtctttttctcgtgcgtttcattagattggcgcggcggttcacaaaggaattacacttgatctgctgagtgatggcgagggcggcggcttctttggggcgcggacggaaaactttcttctccatttcatttccttgatccaatattctccttgtcagtcggaacttgatggcccatcccacagaaaaaaataaagcaacacaggaaaccccaacaatcagcacggacaaaaaaggcgatctcctcgatatcggacgtttcgtgagggtgacagtggttggactggacgcgatgttataacgtggttctttgcgcttgttctgccgcggtggggggaaatggaagattggaactgagctggaggggaaaagttttgcttcttctttccgtctggcctcgcgatggcttgacaccgctcaaggacgctattcgcggcttatttgggggcaaaaaaagtgagtcggcgacagga

SEQ ID NO: 595 - DNA, 247 bp, Trichoderma reesei
cgagcggccgcccgggcaggtcgagcgcatcgtgctcaagaacatgctgctggagcatggcaactgcgggtcggagctgattgagaattatctgagggagagcgccgtgcggtgggtgaagcaggtagaatcgcaagcggttaatgtagaagcggcctgacgactacttaatgatcgtataatgaaagtaatttctcacaaaaaaaaaaaaaaaaaaaagcttgtacctcggccgcgaccacgctaa

SEQ ID NO: 596 - DNA, 271 bp, Trichoderma reesei
gcgagaagaagtgaatacaaagaagacggccaagacttcatagctagctctccaacagtgacagctggggctgactgatggcccttgacttcatagtcaaactacaatgactctctcccgcccaggtgcaatgccgccatcccccttggctgaggtttggatggattccttaatgaatacattggttgaagtcggccgttgcgcatggagttcgatatcatatagcctggaactttgcagcactgacacagacgcaacggagaagacattt

SEQ ID NO: 597 - DNA, 224 bp, Trichoderma reesei
atcgagcggccgcccgggcaggtagaggattctgcatgcctgagttggagttgattatctgagtgaggagttgcgtgtttgtctttttcaaagagcttggtcattgacacgctttgtttttatctcgaacttgcttacggtccgaagcacgaacaacaacaagacggagaacaaaaaaaaaaaaaaaaaaaaaaaaaaagcttgtacctcggccgcgaccacgc

SEQ ID NO: 598 - DNA, 248 bp, Trichoderma reesei
tcgagcggccgcccgggcaggtactccttggcggcctggtggaaggtgctgcggaagaggccgtcggcgagcttcatgatgttggccttgtggatgcaggtgaccttcttgcggccgttggcgagggcaaaggcgaaggcgaactttgcgatgcgctccgacttggcgcgggtgatgatcttgagcgactcgacgacgccgggcacgctctggtgctcgaggcccgagtacctcggccgcgaccacgc

SEQ ID NO: 599 - DNA, 428 bp, Trichoderma reesei
gagcggccgcccgggcaggtacatgtgagctgtgagtgatgaggtgggcctggttgcttttccgcgactgcgtccccgattgagttgcccctgaaggctcacacgctgccccaaagggagactcgcgatttgatctctggtgggtagatagatgccattctttgtcttcttcgagcaactggggatcaagcaaaaaacaaaaaggaataaagagtatttgcgcaagtgaaacaatgcggttgccggccgttctgtcttgttctgttgcgtactgctccgttctgtgatgcttttttttctttctttgcgctctgtgggatttgaaaagatgatgatgcaaaatatgtgtatattagcacacgctcgttgtctctatctcaaccgcctgtgtattgataggtacctcggccgcgaccacgctaaggcga

SEQ ID NO: 600 - DNA, 245 bp, Trichoderma reesei
tcgagcggccgcccgggcaggtttcgaattcagcaacggatggaagctggaaaaaagattcaactaaggagccacatcacgcaatcgagactcatcagaaagggaggcatagaaatccgaaagaacgaaagtgtatataccatactacaaatctacgatttggcttcacggaatggtgggccacagcttcacaaaaaaaaaaaaaaaaaaaaaaaaaagcttgtacacctcggccgcgaccacgc

SEQ ID NO: 601 - DNA, 121 bp, Trichoderma reesei
gcgtggtcgcggccgaggtaccgcgtcctcgacatggctgacggctacgtcaccgccatgaccgagaccggcgacgtcaagcaggcctcaaggtcattgaccagtccaacctgtgtctcgt

SEQ ID NO: 602 - DNA, 97 bp, Trichoderma reesei
gcggccgccgggcaggtactgaaaccacggcgggtgaagcacctggattttcccggtagctggtctgaggaaaagaagctgcttctgtattgccgca

SEQ ID NO: 603 - DNA, 362 bp, Trichoderma reesei
ccgaggtaccgctacctgcttccagattgtgctggtgaagaacctcaactccactcaccgtgtcgagggcatccccatccaatttggtctgtctggagcttatgacaactccgaggccgacatcaagtcgtgggccgccaagaacaacgtcgcttcctccaccgccttcctttcttaagtggggtggcaacgacgaattgtctctgtatagactgaacttcaactgcttgctatctcttgtttggacagatgcattgaaagacgtcacgggcaaaaccacgggcaaaactaaaaaaggtgtcatgaagccctttttacatggtgtcaaggaaaacatggtacctgcccgggcggccgctcga

SEQ ID NO: 604 - DNA, 60 bp, Trichoderma reesei
gcgtggtcgcggccgaggtgccaagtcaaagaactcgtcccagcacaaccagtcgcgcaa

SEQ ID NO: 605 - DNA, 237 bp, Trichoderma reesei
tcgagcggccgcccgggcaggtactctcatcggagccctggtggccgcacccatcgccgaccgcattggtcgcaggccctccatctcgttctggagtcttattgtgtccatcggtttcgttatccagattgcgtctgtcacggcatggtatcaggtcatgattggccgattcgtgtccggcctgggcgttggtgccttgagtttgcttgtccccatgtacctcggccgcgaccacgc

SEQ ID NO: 606 - DNA, 225 bp, Trichoderma reesei
gcgtggtcgcggccgaggtacggcctgggtgtcgcccacacctgcatagaacttgagaaacttctcgtatccccattgatccaagtctccccaggcgcgatgccaatcttggtagatctcttcgagcgccgcgtgccagctggataatgcagctcaaacatgtgctgaaggagcgagatgggcggatgcccgccggggagcttgcgatatgtcctgtacctgccc

SEQ ID NO: 607 - DNA, 458 bp, Trichoderma reesei
gcgtggtcggggccgaggtcgcagaaagcttttaacagctcagatttccgtatatccagacctctccgccccttcacattgttcgtctacgagcccaacagctatatccatcgtcagtatcgcgaatattcgctgctaaaagatccccgaacgagcttatccctgatccaacatggcttccgtcctccaggtcctctacacccagcccaaagagggcgagttcttcgacatggactactacgtcaacaagcacatgcccattgcgaacgggcactggacgcccctcggcctcaagagctggcaggtcatcaaatacggccccgacgcgccctattacggaggagtcctgttgcactggggagaaggccgaggacgcgtccaaggctttgacggcggccgagtcgcagcccgtgttcaacgatgttcccaacttcaccaacatgaagcccatcctgctt

SEQ ID NO: 608 - DNA, 321 bp, Trichoderma reesei
ggccgcccgggcaggtacgacagcatcatgatgatcatgttgccgcattcctccagaggcatggcctcgtcattgccatcgggatagcccaacgctcgcgggaacctgccaagatcgtggatcgcatacttgttggggtagtggccgctctcctggttctcgagcaggggcgacagcgtatacttgatcaggttgggatccagatacagcatgattggccacgtgggaaagatgacatccaccgtctggatgtcactgttggagctgatctccttgagaaacacctggacgttgtcgcgggtacctcggccgcgaccacgc

SEQ ID NO: 609 - DNA, 392 bp, Trichoderma reesei
gcgtggtcgcggccgaggtacatacataagtggtaggcctgtaggcatccggtggacttgattcacccgaatagcactaccttccatcaagccccgcgtagcagcccagctagacaacttctgaggtcacagaagtcacagaagtctgactctgacatccggcctcaagtgccgttatctctcttcgtctcttctaatttctcattgccgcctctcatcttctaatctgttcagatctcacctctgcaaattttttgtgccttaactgtcgagttgacaaagtcaaattcctgatcggtctcgatcaccgtcggagtaatccagggttcatgctgtcgcgctctgtgaacaaagagaagctccggaaccccaccactgggaagctatcgaaa

SEQ ID NO: 610 - DNA, 439 bp, Trichoderma reesei
tgcagaattcgccctttcgagcggccgcccgggcaggtgcagcgtttgctccccattcaaggcttgactagatttatgcttattctttttctcgccacgccattttctttacgatatacattttaatgcgcgagtgccgcgagacgtaactcgagcggcggcgtcagaagaaaacctgcatctcagctgaaactgatggcggtatatcattgctcttgcggaacgcgaacggctattgctgctcatagaggcgattgaacaatgattcgtatactaggaggacccctgcaggccgccgtctttgtcgtctgtgcgcatgatgcacttttgctaaggccgtcgcgctgattattcaccaaggcggagaggcgagcccttttggggtctgggactggcggcagagagaggcacgccatgagagctgcgctacaccctgagc

SEQ ID NO: 611 - DNA, 76 bp, Trichoderma reesei
gaggtacaaagcatcagcgccagtatagggtcagtagtatcaagattagagctcttgactagggacctctaaagag

SEQ ID NO: 612 - DNA, 274 bp, Trichoderma reesei
cgagcggccgcccgggcgggtacagtatcatcgccgcaaacaaaggccacttacacgtcccacattgcctccgctttcagccaaataccaccatgacgggcagaccccatgggccagtgagcataacgcagaagcttctcctcgtctcccccaaccgttcatgcccatcggaatggagcagtggaggggcaaaagaagaagaaaatgtctctccccatgtcgatcaaagttggaggggtcggggcaattccgcgtacctcggccgcgaccacgc

SEQ ID NO: 613 - DNA, 197 bp, Trichoderma reesei
gcgtggtcgcggccgaggtcagcattctgcttgctctggttctctttttttttctcttttttttttttcttctttcttcttgtttctctctctctctggtccatcattcacctcgaccgtcgatcccattttcatgtctcgaagcagcctcgtcccatagttggctgccgccggcacctgcccgggcggccgctcga

SEQ ID NO: 614 - DNA, 354 bp, Trichoderma reesei
gcgtggtcgcggccgaggtcaagctttttttttttttttttttttttttttgaaagtatccaaaacatttatacagggcatctaaccaaagaaaacagtcattactaaaacaaacatcgcatttgccctctccccccttgaatagcccccgatcctcccacgactcagatgcctcccagaaaaccatttccatcatattccttcctccttcgggagagacaacaaaagaacaaaggagcattcgtttgtcacatggagagccttggagaatcacaaaaaaagaaatgtagtatccgccgacaaaacacatagccaaagctcccattggcaaccttttctttcctcgggcaaaga

SEQ ID NO: 615 - DNA, 318 bp, Trichoderma reesei
gagcggccgcccgggcaggtacacgggcaggtgtgactatggcgtccaccggagaagcgctgatggactgtgatcgcagatcggagggcgacaggaatgcagcttcggacttttcgtcgtcttcgctgaaaatgtcaggctgtcatctcgccccagtcgcggtgaatgctgtttttacggccttttgagctccagggactgtcgttgacagagttgtaaagctcgttagactcgtcgtaaaggtccggtggtggaacgtattgaagacgggctcgtgactggagtgatgacctcgtctgtctgtgtcccagcatccga

SEQ ID NO: 616 - DNA, 290 bp, Trichoderma reesei
cgagcggccgcccgggcagggccggcatctattttccagctgtgactttccgaagccggccacatcattacgacctcacacccggcttatattaacatatatatacacatcatatatatatatataagctcttttatcgcccctccgagaagagaaaccgttgaagaagaaaacccaaccaaggaatcctctccactcctcttctctcttcaaccgccaaaatggtcaaagtcctcctcgtcctctatgatggcggcaagcacggccgaagaagtccccgccctcctcgg

SEQ ID NO: 617 - DNA, 305 bp, Trichoderma reesei
gcgtggtcgcggccgaggtaccaaggctggcgagttggtcatagccaagggagtaatatgtgagtccggcaaggcgatgatgtagcccacagtctgaaggaaggtgatttgggtagaccagatgagaacagaggcgataacaagcaggatactcttgaagatgcctgtaagagtcatgactaggcccgaggtcttgccaatcagaaacacgctggcaacattgaggacaaaggcaatggaggcgttgaggaacagcattccaaatccggcattgacggcgtcgacctgcccgggcggccgctcga

SEQ ID NO: 618 - DNA, 222 bp, Trichoderma reesei
gcgtgagcgcgccgaggtgtcgagaaggggctgagagggaggctttcaccctctctacctacctcttcagtgcttgtctctgtttcatcatacgggctagttacctacgttgacctatagctctgttttattctactttattgttctgattcagggatctatttgatgatttctttgggggggtcacgggtaagggcacaagggttcggatggaactacgga

SEQ ID NO: 619 - DNA, 243 bp, Trichoderma reesei
cggccgcccgggcaggtggcatccccctgagcgccgtgtggtgcttcgaaccttgcgcgcaacgtggtcaagacggagggggaggaggagctcctcaaggagcagtctaggacagctgaaaaggggggctggaacgagaggctgttccggccccatttgtcgcagctgtatggtatcttggcggagaaccttgccatgagcccttatatcgcttcattactggagttgattatccctgcgcct

SEQ ID NO: 620 - DNA, 195 bp, Trichoderma reesei
agttggacaaccgattagacggtatggaaagccgcttcgaagagttggaaagcaacgtgttgggtgcaatcgagccaactatagcccttgtcgcttccgcccagaagagagaacggagatctttgaggagatacacgagcagattgaggactgcacactgggcatgaaattcgactgtgaggagaagctgaagga

SEQ ID NO: 621 - DNA, 130 bp, Trichoderma reesei
gcgtggtcgcggccgaggtgttccactcttgtatcatcgtctcggcatggctcccctggctcaggctgtaacggtgtctctcaaggacttgcagaatggagacgtctcctttgagactctgcagcaggcc

SEQ ID NO: 622 - DNA, 157 bp, Trichoderma reesei
tcgagcggccgccccgggcaggtacatgcaggctttgttaaccctgcatcttctttctcttgccgatctgggcagagaaaccagtcttgatggctgtgacacttcgtcgtgaaccgcagttgttgcaggtgatgaagtacctcggccgcgaccacgc

SEQ ID NO: 623 - DNA, 317 bp, Trichoderma reesei
gcgtggtcgcggccgaggtccgcaactgacgcagcaaacaccatctccatcccccaaagcattgctcccagtctcgaaccagcttctccgccaaaacgattcactccatctggatttgtcacgccccataagaataacgacgacgaaaaagaaatactatacgaattcgagtgccccgcatccgggaagtcttcgtatcgccacttgaaccgatatctcaaaccacagccagcgaaacttgttgattccttgttgcctgcgcactacatcgccatctccccgactactccacataaacaccacatccagatggtcac

SEQ ID NO: 624 - DNA, 222 bp, Trichoderma reesei
tcgagcggccgcccgggcaggtcagatgaaaacaaagatctgcaagatggcactgctttgtcgacggacggcgatggctcggatgcggcgaaaaaggccgccgagaaggtcgagaagctgagagcacggcttatccagagaaatcagcaactcgagaagtcggaacaagaaaggctcgagcttcaaacgaggctcaaggcagtacctcggccgcgaccacgc

SEQ ID NO: 625 - DNA, 329 bp, Trichoderma reesei
gcgtggtcgggccgaggtacatgatcatgcaagcaccgatcacgtcgcgcatcctttcttgcggaagaagaaaaaaagatgggcgacgaagacgggaaacgtgcttggtgccgagaccctcgtggccaagaggttgttgaagacattatcccgtgaacgcggaacgttgggttcgccgaggtggttgttgttctttttcccatgagtcgcgccaacacaccaccccccgttttcgccgttgtctgtatgaatcacggtctcattactgcgttgcgtgcgtggcccccctctctcaccctcgtcaacttctcctttctgcaccccctagg

SEQ ID NO: 626 - DNA, 62 bp, Trichoderma reesei
gcgtggtcggggccgaggtaaaaaatgatccagaagctttccaacctccttgtcaccgcact

SEQ ID NO: 627 - DNA, 180 bp, Trichoderma reesei
tcgagcggccgcccgggcaggtacacgggcctcgggtgttcgccgaatcaaacagaggcgggcgcgcggtcctcgatcgatcgatcgcctgaggaagaagagaagaagtctctcagagcaaatgtttcagagagaagaagctggccggtgggggacggcgatttctcaagagttgaatgg

SEQ ID NO: 628 - DNA, 303 bp, Trichoderma reesei
gcgtggtcgcggccgaggtacgactttggggagcaggaggagatctggactcacatatgtcctacgcatgaggcagtcgaggcgcacatgaaacaggttcgatgaagtcggcgttctttcagacctgctggttcgctgaagcagacaagagcatggtgatagaccctccttacaagtatgccgcaagccaagagtgggacggttttttggatatcaagatagaggcatatatctacatatgaatgacgcgcgatgatttcatccaatggttcttcgagggcgattcagaacatatcagaagaa

SEQ ID NO: 629 - DNA, 409 bp, Trichoderma reesei
gcgtggtcgcggccgaggtacaaggagctgaagagggacgttgccaacgaggtcattatgtaaaatgcgaattcaagcacggttctcgacaattagcgtgtgatagagcaacatgggagtagcatgcaattaattgtttccctaagggatataaaaacgaaacgagggacgggagaacggaagatggaaactgcttttcaacacatggacaccaaacttataaaaaacaaatgattgattccccagactatacaatgtcatgtcttctggttcctgcctaatactccaaactcaagaagtgtggttctcatccaaggattgccttgatgcttccagcagctgttgagatgcgcatgggcatatatgtatgtataatccgtggaaaacaggtacctgcccgggcggccgc

SEQ ID NO: 630 - DNA, 324 bp, Trichoderma reesei
gcggccgccgggcgggtacagatattgtgatttttgatataagcctcccatgtccgctccgattctacggggcagcgagcgatgatatcgtgtgtttgcgttttttttctagttcttgggaggagactggacgacacccttgcccttgtatccgggagaagagataccagtgagggggtcggcgttttgttgctgttcggatttcggggtcagccaatgtcatgtcccgggccagccaaaagatgagagaaaaaacgccacatgcaaggggggaaggagatgcatgagcaagcttgcatgtttgtacctcggccgcgaccacgc

SEQ ID NO: 631 - DNA, 162 bp, Trichoderma reesei
tcgagcggccgcccgggcaggtacgcatcttgccgcgttgtgtgggttgttggcgacaaggtgtatcgtcgggatttggcgggtgagcagaaaaatggtggtgagcagccgggtcgctgggataggttcaatttcacgaattgacctcggccgcgaccacgc

SEQ ID NO: 632 - DNA, 336 bp, Trichoderma reesei
gcgtggtcgcggccgaggtacgctgctccaagccgttccccgtcaaggaaggcggctgctacaagctcgagtggtcgaccaagggcgctctttcacacacgacgattgaggtcaaggatgcgggaagggcgagatggtctactacagagatacggatggcaagtggaagcccaagaagaatgagctggtatatctggacttcaagcccaaaatttgggggcaagggaacgagactgttgattacgaggtgacgaggtgcgatgatgataacgagttgtgagcaactgcgatatggctgtaatcagattgaacacatcttagatattcacatgggtg

SEQ ID NO: 633 - DNA, 291 bp, Trichoderma reesei
gcgtggtcgcggccgaggtaccatgaaatgatgatagagaaaccggccttgataaatcgaaaatctccagaatacgccaccgggcgccagaaccccacagcattagataaaggatgcttgtccccatcgtgactgctgccggttcaagtaatgatgatgacagaaatgatgatgctgataatgatgatgtgttgtactatacgcatttgctggacacttataaggagcggcaactttgcttgcagacgtatttggatgcgggccgcgagtggtacctgcccgggcggccgc

SEQ ID NO: 634 - DNA, 286 bp, Trichoderma reesei
cgagcggccgcccgggcaggtacgtatcgtctagagatgggattcgaaagactggtatggaagagcacgcgatgccgaggggggcattcaggtcgagtcgaggggcgattgtcggtgccgtttgtccgtcgaggaacacagccaatatgaaggctcggtaatcaaacgaatgtcgagaaaatggaatgagagcgtagatggcaagggagagtaggtggaagcaaacaaataatacgaggaagagagaagaatagaggtcggaggacctcggccgcgaccaccctaa

SEQ ID NO: 635 - DNA, 416 bp, Trichoderma reesei
tcgagcggccgcccgggcaggtacgggcgaaactcgtttgctgtcgactcgcaggatgagggagggaagaattgcgtataagctacgtttctaaacggttcgaagtgggatgaggagtcacaattttgatgatattttgcgctcgagccagacgttggtggcggggtgtggctcatcctaggcggtcgataacggcaatttctaagccacagccacgattgcagcttatcttcacgtgataccccaagtaaacaaccaaagcttcatgcttggggcaacggctgccatgcatcatcaacccaaacaatggctccaggtgcgtagaatcgctgcattttgtgtgtttccaactgcgatggcagtcaagatatgctgacaggcgctgtagcaacgcagtacctcggccgcgaccacgc

SEQ ID NO: 636 - DNA, 344 bp, Trichoderma reesei
tcgagcggccgcccgggcaggtcatgggaatgctaaacgatgccggcatctatgtgatttccgatctcggcaatccgggccagtcgatcaatcgtgagaatccccagtggaacgtagacctcttcacgcattttcagcaagtcgtcgactcctttgccaactacacgaatgtcattggcttctttgctggcaacgaggttaccaacaacgctaccacgacctcggcttccgcatacgtcaaggccgctgtgcgagatgtaaagaagtatatcaaggacaagaagtatcgcgccatgggcgggggctacgctgccgatgacgacgcggacatcagagaccagatc

SEQ ID NO: 637 - DNA, 236 bp, Trichoderma reesei
gcgtggtcgcggccgaggtgtgaggattgcgcaggttggtggtgttgaggatgacggtagatgatgagggcggaagagggcgggtctggtgagggatgttgggcggatgaggcgtgttagtgtagaggctgattttgcggccatggtgttcgattgttgggcgccgatagcggtcggagtgggcagtcgttgggcgaggataggatggggagagaacctgcccgggcggccgctcg

SEQ ID NO: 638 - DNA, 399 bp, Trichoderma reesei
gcgtggtcgcggccgaggtacatttcaggctatgttcgatcttttggaagccgatattgtcgtactgcaagagaccaagatacagcgtaaggacctgacggacgatatggttttggttcctggatgggacgtctactttagtctgccgagacacaaaaaaggatactctggcgttgccatctacacgcggaatgccacttgtgcacccattagggccgaagaaggaatactgggtgtgctctgccctcccaaatcaactacccagtttcgaaacctacccgatgaccagcggatcgggggttaccccaggccggagcaactctcaggaaacatcgacgaactgctgctgaattccgagggagatgcgttattctcgaattccccgcctttgtgctgctg

SEQ ID NO: 639 - DNA, 323 bp, Trichoderma reesei
gcgtggtcgcggccgaggtacgtgatgctgaagctcaacggccaggagctgagcttcgacgtcgacctctctgctctgcggtgtggagagaacggctcgctctacctgtctcagatggacgagaacgggggcgccaaccagtataacacggccggtgccaactacgggagcggctactgcgatgctcagtgccccgtccagacatggaggaacggcaccctcaacactagccaccagggcttctgctgcaacgagatggatatcctggagggcaactcgagggcgaatgctttgacccctcactcttgcacggccgcggcctt

SEQ ID NO: 640 - DNA, 375 bp, Trichoderma reesei
gcgtggtcgcggccgaggtacagagccaagagaaggccaatgagaagagcgaggtgggaaatgaagccggaacaattcccagtctcgatgaaaaagctcttctcgctattatgtttgcttggaacatagaaaatggcgtcacattcttctagatgagggatggaaagaagagcatttcggggcgtggaagaaaatgaatcatgatgatcatggcatgccatttcaacgactacctgttgataccgggcgtcactggatgcccgcatgttctacgcatggctgtcattatgcataggaagcattcagatgaaaagtcgaactgcgctgaggagtgcttttgggcgttacctgtacctgcccgggcggccgctcgaa

SEQ ID NO: 641 - DNA, 147 bp, Trichoderma reesei
gcgtggtccggccgaggtacaagatcttcatcgtcttcggaagagtcgacctcttcgatgatggctatcgacttgatggtggagatgctgggttctggcttcgcttgggggttcgctttggactttgacgtctgtttctgtgatggg

SEQ ID NO: 642 - DNA, 177 bp, Trichoderma reesei
gagcggccgcccgggcaggtgacgaattggttttcacgagccgagggactggtcgggacggagaggacaagaaatggacactctcttttctccttgggcaggatttctgcgtgttgccaattggtgtttttgttatcattaccatcatgatttcgggtacctcggccgcgaccacgc

SEQ ID NO: 643 - DNA, 395 bp, Trichoderma reesei
gcgtggtcgcggccgaggtacactgttggtatttttggcctgcctggctggacctgtccctcgcctttccctgggttacacacgttataacgccgatcctcccaacgccgcagaatacatgatcaaacaagccacttgcggggcatctcgtcggggaaagtctttgctcgtcctggtgccatcgacttcatttttttttttttacccttctttctgattatcatcccgctggcaaccacttagatttccccccgtttcgtcgtgagtgggcaacccacctgccctcggtcgtgaaagaacgggagggtgcccatcgtcaatcttgtcgtgtctctcaatcttcatcactttgggcggcagaacgtgccccgttggcttctcgacctgcccgggcg

SEQ ID NO: 644 - DNA, 182 bp, Trichoderma reesei
tccctattccgaatttttttccagcaaatcagccatcaaatgttcccaagaaggagcaccaagagttgaaggatatcagaaatcaggaggggggtttaaaccaacctcgtcacactgctatcaagctcatcaaacacatcagcccccgtcgtgctcagattctccttgagcacaatcagccc

SEQ ID NO: 645 - DNA, 215 bp, Trichoderma reesei
gcgtggtcgcggccgaggtacgtcacgtagtccatgaaggtggccagggagcccgtagcattagcacgcacgtatcggaactccgagatgagcttgtctgtcgtctttgcggcgagggcagatgttgatgggttcggggggagggatgcgaggaagtcgccgtaggcaggcccgagctgtagcttcagatcatcgatggtctcgcattgtgtcag

SEQ ID NO: 646 - DNA, 198 bp, Trichoderma reesei
gcgtggtcgcggccgaggtaccgccgcgtgcgcaccaggtccttggcttggatcttgcacgcccccatctgcccgttcttggcgctcgtcttgatctgctgtatcagcgtcttctcctgcttctccagcttgacgcgagtctggtcgagttcgcgaatcgccttgtcgagcatgcgctggttcttgcgcagccgctcg

SEQ ID NO: 647 - DNA, 561 bp, Trichoderma reesei
gggtggtcggggccgaggtccttgagcttgtatatctttgttctttacgccctcgactctccccttcttttttgcgacctctcgtctctatcggaaactcgatatatttcttcgagaatccttcccttcttttactcgcagtcctcaactcatctctgttctgcgcaacaaaccacccttcgcaaacatcccctcctcttcctcctccatcacccttaccactaccaaagaccgccatccattctttcacccggagccgaagacgaccctcaccactctttactctctgcctcttcttacaacaacctgattgcctgggcaattgtataatacggactactacttctactatacaacaaaccaataacgcttaatatctaaatctatacccttcgggactcggaagccatcgcaaacacacaaaagagacaagcaatggacggcatgatgtctcaacccatgggacagcaggcgttctacttctacaaccacgagcacaagatgtcccctcggacaagtcatcttcgcacaacagatggccgcctaccagatgatgccctc

SEQ ID NO: 648 - DNA, 144 bp, Trichoderma reesei
ccgaggtaccttcgatgtctccctcctgaacatccagggtggtgtcttcactgtcaaggctaccgccggggaacccacttggtgcccaaaacttcgacaccaacctgctcgaccactgcaagaaggagtcactcgcaagaccaa

SEQ ID NO: 649 - DNA, 772 bp, Trichoderma reesei
gcgtggtcgcggccgaggtacacgccctcgctggaggatgcacaggcattcaaggccgtcgccggcgctgttgtccgcagagcgggcaggcttgcggccgtcgccattggcccattgtcctccagtccggaaagctggacgaccccgaagaggagctcatcgacattggcgtcgacggcagcctggtcgagcactaccccttcttccgagacatgatctacgaggctctgcgcgccattgaggacatcggccccagcggcgcggaaaaattcgcatcggcatcgcaaaggacggcagcggcgtcggcgcccccctgtattgcccttgatagcccaaaaaaggaaaaaccgggaattttcttggccgacttggagggaattcgagaagactgttttgctttcgaatgtgggaaatcgagattgtctggcaacctataaaaccgcacgtgatgccttttttttttttgaaaaacggagccctttcaaacttcaatatttaggggaggagcaaaccccacaaaagggattccctttttgggaaattttatctttctgggaaaaaaattccctgggtaaaattttttttgcccaactttttccccctttattggggggagattttttttaaaggggggggctttggaattttggggggggggggggggccaaaaaaaattttgggtttaagaaaaaaggcgccctttttttttttttgggaaaaaagaaatattttttaattttgcgggccgcggggcggcgcgcgcggcgagaca

SEQ ID NO: 650 - DNA, 333 bp, Trichoderma reesei
gcgtggtcgcggccgaggtactccaagagggtgactcgggaatagggctcatcctcacgaatgatttctcgcagagaaagaaggatcttttcaccgtagtggggaatcatgaccatgaaggttggcatgttgtccaccggcaagggttccgggataggggtagagagcgactgggcaaagaaggaaattcggcgttccgcctcactgttgctggggaagaattcggtcttgaaggagtgatcttcctgagacacaaagaacgtcggggctcgcagtgttcgctttccttcttgctctgatgggacctggtggtacctgcccgggcggccgctc

SEQ ID NO: 651 - DNA, 248 bp, Trichoderma reesei
gccgaggtacttgacggattctgcatatggtctcatttcgggtgacgagcgcgcggatacgaagcccacgatgaggtggacggcaaaagactgatgaaagaggtttaggtgatgagaggcctggttaagacggatggatggctgaatcaaaactaaggtatgaagcatatagaattgcaatccgcccctagagagacgagccacttctcctccgtgagcggtttgtacctgcccgggcggccgctcga

SEQ ID NO: 652 - DNA, 265 bp, Trichoderma reesei
cgagcggccgcccgggcaggtacacttctcatgccggtcacaacggcgctggtgctggggagaactattagttgaccgtcgattagttggtcatcgtgacgccagcgttcgccgaactgcagacggcgacctcttttcccctcagaaaacccgccctctcggaagcccgatcggacctctattgccctataggaaactcttcctgaacgcttcacagccaggtaatggtggttatcggctcgcttctctcctcatgtagaggtag

SEQ ID NO: 653 - DNA, 62 bp, Trichoderma reesei
gcggccgcccggggcaggtactcatttgccctaaggcgttgcagccagcccatcgcacacga

SEQ ID NO: 654 - DNA, 51 bp, Trichoderma reesei
gctcgcagacattctcaaacagcttatccagcgcctcgacgtatacttgga

SEQ ID NO: 655 - DNA, 281 bp, Trichoderma reesei
gcgtggtcgcggccgaggtacaaggccatgtgagtccatgcaaagttggtaaactggaacttgtagtgccctgcctgaagggaagcgacaaagtagacaaatccaaagacgtagagaataaagctgatgaatcggtggtgggtggcgagcggcagaagcaccttgtcgacgagcacaatgtgcttgaagtagtagatgacgctctctccatagaggaagtacatggtggtggccaggaaataccagttcaggctcttggacctgcccgggcggccgctcga

SEQ ID NO: 656 - DNA, 299 bp, Trichoderma reesei
gcgtggtcgcggccgaggtccttaacgctgtcggccaggacgacttcgaggacgtcaaggtcccggatgcgccacgacaggccaaatgaacgacattactgttatctgcatattcaaacttcaagagggaattaatttaggcgacaacatgggggcgcttgggtgttgcgaatgaacatctgtcagctaatatgctgtgtattatatatcaattcttttccagactttgggactgggctcgatacctctcgagcccaaggctgctcgctctctcctgtacctgcccgggcggccgctcg

SEQ ID NO: 657 - DNA, 111 bp, Trichoderma reesei
gcgtggtcgcggccgaggtacacaggggctgcctagagatatgtatttccgcgaaagcagcagaccaggggcgtgtatatttgcggcatgcacatggggcgtttattttct

SEQ ID NO: 658 - DNA, 240 bp, Trichoderma reesei
gagcggccgcccgggcaggtacggcgtcgccgtgaggccctttacgaggggtcttgggtggacgctcgaggaggtggaggtgtatctggtggatgtgaggagggatctgatggatgcgagtcagcatggctacacgccgtttcatgtggtcacagggcggaagccgggatgaagagagatggaagatgtagggagggaggggggttattcaagcataaggtacctcggccgcgaccacgc

SEQ ID NO: 659 - DNA, 313 bp, Trichoderma reesei
cgagcggccgcccgggcaggttggaaagatagtcccgaggaaaatgaaagggctgacttctgaaaagaagaagagagaatcgtcggttcgaaggccgtaaagcgacacgtttatgtatccgagagtgggcaattggagggcagagtaggtccagtgaggtttggtggaggggcgggcaacttgcaatgagtggcagatgagccgccaaagtgtgggaagattctgcctaccttggccgcggccgtggttggtcaaaggtctaacggtaaagttggagatgatctagcgggggtggtaaatgggggccaggaga

SEQ ID NO: 660 - DNA, 326 bp, Trichoderma reesei
gcgtggtcgcggccgaggtacaagctttttttttttttttttttttttttttggccgatacgaacaaaagctctggtaggataatgcaagaagtatggtttctgtagacatccatcaaactaagctacacgatacacaaatagagtaagacgtaagataggcaggtattgaacgagtgaacgatgcagggcagatacatcctgcatcattgaataacagtctgcggtcaatattcggactcaatctgaggtgcaacaatactttttgttcaaagacggtattgcaacgccagctcaccaggtgcatgatacgtaggaaccttcatc

SEQ ID NO: 661 - DNA, 272 bp, Trichoderma reesei
gcgtggtcggggccgaggtactgacagagcgcccgtgcccttactctccccatgccggacgtgcgacttgctcagtcgaaccccagcacgatttgacgagatcactagaagtctttgctgtatacaccttcttcaagcagagattgacgtggctgtttttccacgtcgattgctctctcatctaacaaaacctcaataaaaaaacatgtgtccctttgggaaacgggaaagaggaaaaaggggagcttgtaccttgcccgggcggccgctcg

SEQ ID NO: 662 - DNA, 410 bp, Trichoderma reesei
ggatatcctgcagaatttcgcccctttagcgtgggtcgccgggcccgagggtactttgagggagggagaggatggaaatttctatggatacccaaaggggacctccggtaaagggcgaagggcagccctttctttggtaaaaacctggaccgtttaaagggaccgaaaggcaccagaagcaaaaaccgggatttagaatccccaggaagtcctttgcaggtaaatggatgaatggccattaggttaaattaaaatttagtaattatatttaaaatttaattattaacctttttcgggcctataaaggaaagggtaaacctttccccctcaaaattattggggcaccccaggaacctgaaaatcactagaaccgtttctgacaccagtagtgaagtatgttgtttaattcg

SEQ ID NO: 663 - DNA, 96 bp, Trichoderma reesei
gcgtggtcgcggccgaggtacaagcttttttttttttttttttttttttttttgcaatgagcatcacatagagtattcatagctgctgacttttat

SEQ ID NO: 664 - DNA, 233 bp, Trichoderma reesei
tcgagcggccgcccgggcaggtaccgttttttgttctagcacacaccaacgccggcagctgcaacaacacctgagtggaagaagaagacggttgttgaagaagaataagtaagaagaagaagaagaagaagaagaagagcagtcgtcatctgcacaacgcaaatcgcctcagcagctcagttgagtccaaacgcctccttcgccctgttccagtacctcggccgcgaccacgc

SEQ ID NO: 665 - DNA, 284 bp, Trichoderma reesei
gcggccgcccgggcaggtaccccttatcccttatcctgccttttttttttttttcctttcgatgatatcaagcgccccgcagtaacaatacaagggaagggggacagacgctgtcactaggcttcacgtgctttgaatagatgcattgatgttgttcacaagggtcttgtggcctgacgtgtctgttgttcccctctagttgtgcaagttctctatttcttttcttctctttttgaggaatggccttgaaagggcttctgggctggattttagcgttggggaag

SEQ ID NO: 666 - DNA, 237 bp, Trichoderma reesei
gcgtggtcgcggccgaggtctgatccctccaagcacacgagtgacacacacacacactcacactcacactcacactcaccatcatacttgccatcatacacaaccatcttccatcactactacttcttttctttctcctcctcctcctccttcttctcacctttgtcatctccatctgcgagcctcttcctcagcttcgcttcagctcttttaagtacctgcccgggcggccgctcg

SEQ ID NO: 667 - DNA, 234 bp, Trichoderma reesei
gagcggccgcccgggcaggtaccttgaaagcttgctcaagcagaagcttggccatcatcgttacgttggtgacattcgaggccgcgggctcttctggggtatcgagtttgtgaaagacaaagcctccaaggcaccgtttgatcgtgagctcgacattggcatgctggttcaccagaagggtctgagcttgacggaggatggtggaattatgttgtacctcggccgcgaccacgc

SEQ ID NO: 668 - DNA, 397 bp, Trichoderma reesei
taccgtgggtcgcgggcccgagggtactaaacgccctttttggtgggtggtctggaatgagccgttcttacttctgggcaacctttaacccttcgcggtttcgggtttcattccccgccattcgcccaagtttcctggctttaaccaaaaaaatgggccccaccttaagtggtttggaataacatttccgaatggccccaccgtttccaatttaaagccaaacaaaggggctttctttaacttaattttaaaagttttgaagaaagggaatgaaaggcaaataataagccgccccccggggtcccctaaatcatttcgccttttaacctcaataaaaacttgaagtttcgaacaacttgctaatcctgaagaacctgccccgggccggccgcttcga

SEQ ID NO: 669 - DNA, 359 bp, Trichoderma reesei
gcgtggtcgcggccgaggtacgtattgcaaggctttcgccagaaacggctgccatccctcgctgctgaataccttacaaaaagtcacctaaaactccgtggcagcaaccgccgttgacgggatgcttaaagtgatgacacgacctcatcttcctccacacggatcgagtgctcagcacccaacgcttggacagaggcgagtgccttttccggcgcgattacagcgaaacctctaatgatagtgtagaaatgagtgactttgccaccggctttgagaatgccatctttaacttggttgactattgcgtcaggtgtagaggcgtcgtcaaaccagataatggcagacttcttttgatcaac

SEQ ID NO: 670 - DNA, 173 bp, Trichoderma reesei
tcgagcggccgcccgggcaggtacaagcttttttttttttttttttttttttttttttttttttttttgaaaagttgacacgcaaaatactacaactatcagatgctatccgcataccgacccgggggcaacggccttagtcgatgaactgcactcatgcgactgctattggc

SEQ ID NO: 671 - DNA, 163 bp, Trichoderma reesei
cgagcggccgcgggcaggtacgctgcatggtgcattgccgacgacgcagttgccatgtgatagcatcagacggtggtcggagaggccggtcaatgtcataacaatgaccatcaatgcgccatgtagaccgaacacacaaagactttgcagcagaaaatgtgcg

SEQ ID NO: 672 - DNA, 250 bp, Trichoderma reesei
cgagcggccgcccgggcaggtacgcccacatctccgaccttgccggaaccaagaagccctacgtcctccccgttcccttcatgaacgtcctcaacggcggttcccacgccggtggccgtcttgccttccaggagttcatgattgttccttcagaggctcccagcttctccgaggcccttcgccagggctccgaggtctaccagaagctgaagaccctggccaagaagaagtacctcggccgcgaccacgc

SEQ ID NO: 673 - DNA, 249 bp, Trichoderma reesei
gcgtggtcgcggccgaggtacaatgggcgatgtggtgagagctgcagagtggcgagacgagggaggggagcaggagggcgggcggtttgatggccatgatgagacacagattttgcaggacaagatgaatcggttttcttagatgaggcgggtgtgtgggagcatgtccgttgatatggtggtgttgaatgtggttgaggttgtggtgatggtgatggtgatggtcgtgtgacctgcccgctcggccgc

SEQ ID NO: 674 - DNA, 315 bp, Trichoderma reesei
gcgtggtcgcggccgaggtacaaaattatcaaactacgttgaattgaaattgaaatttcttttgccattttttcaatggggggggaattgctactgtcatcatcttcagacgttcctttgttctctcgtcttccctcccctccctgcggggcgacaccaacatgggcacgggattgtaagaccacttgtggtgaaaaggggtcgaggaggggtccggggaaaagaaaagagagaccaagacgacacgtgaagacacaacaaaaagcagcagcatattgcgagagagagagaaacgacgacatcagatggggaaac

SEQ ID NO: 675 - DNA, 115 bp, Trichoderma reesei
caacaacaaggtggaaaaaaggatcgacacagtataacgccacccatcaagtccaagagagccccgagcccttttcctagcccccgcccttctttacctcggcccgcgaccacgc

SEQ ID NO: 676 - DNA, 103 bp, Trichoderma reesei
agacacccaactcagctctcgcaacatcatctgcttctccaacagcttacgatccagaaagacctgcagcagaagaacaaaaggcgaaaggaagacggggtgg

SEQ ID NO: 677 - DNA, 413 bp, Trichoderma reesei
tcgagcggccgcccgggcaggtacgcttccttgctttctttgggacactggatgcgcagagggacaagggacaaaaatccggaatgaatttacgactctcttttgtgaactggtttatacagatgtttcattcaacttcttaatctattggcgacggagttctgggctgggtatctgaaattgggagcaaggcaacaacagttggcaaacacaatgttttctctcgacacacggggtatggcttggttggtcacttaaaagagaatggagtttgtctttaaacttggcaacaagcatgcaatcgcgggggggggaaggctggatctgctttgtgaaattacggcatgcagactggcaagtagagtagacgacgtgttaataaagctgacttcagtggctgtttagcaactaac

SEQ ID NO: 678 - DNA, 225 bp, Trichoderma reesei
gcgtggtcgcggccgaggttggagtttctgttttcttcacttcctagattatagattcagccgttgttgtgtttcaaacttttttttttctgttttgttataccagcgttgtaatatctcgtcttgatacatattcacttcaaaacggcttcaagagcgtccatgaattaattcctcaggtatattactttatacaatttgtacctgcccgggcggccgctcgaa

SEQ ID NO: 679 - DNA, 125 bp, Trichoderma reesei
gccgaggtccagacattaccgtatccgaatctacataggcttcctctccctggcaggcagctacatcaccgtcgcgatgaacctatacctctcatgccggcctttccataagctgtggcagatat

SEQ ID NO: 680 - DNA, 239 bp, Trichoderma reesei
gcgggtcggggccgaggtacggaaacccctcgaacgaactgactggcctgtggaacgcaactgtcgataagctattgggggtcctcactgcagaacccgggattgacacactcgcggaaatgtatcagtgtttctacgagtctgtgcaagtcctggggaaagggtgcctgacaatggatcacatgaatcgcttcattgactccgccctttctgcgctcgaagattataaggaccgggtt

SEQ ID NO: 681 - DNA, 213 bp, Trichoderma reesei
gcggccgcccgggcaggtgcgacatctccccctcccggctacctccttacttatatagagttggtagagtcgggttacgtcctccatcctctcgtttgcagtaacaccgtctcgcacgtggaggaatccgcacaaagacgaggccaaaggtccacgaaaaaacctcctccctccccccatcatgacggccgagtacctcggccgcgaccacgc

SEQ ID NO: 682 - DNA, 446 bp, Trichoderma reesei
cgagcggccgcccgggcaggtacaagtaaccaccattatggacgagcaagacggaaggaaacaaagaaggctcagcttgtgtcttctttctcgtggaggagccgtttattgacgtggcatgtgagaggtctctggttgctagagactgacgaaaagggatatcgaacggtttagcccagcatgtgcagcggacgggatggacgacgagatgaggagtcagttgcagtgcatgcatgcaagggggcatacctgggagactatgcaagacacgcttgtttattcacgcagctcggtcgggaggagtgcgattgctgctggcgggccaaaaggactcttggtttgggaggggggtgagagacaacctaggtaggcgtgttttcgtgtttgagaatcaaggctctcttctagtatgatgaatttagcatgtacctcggccgcgaccacgc

SEQ ID NO: 683 - DNA, 238 bp, Trichoderma reesei
cgagcggccgcccgggcaggtacgaggacgagggcaactacgtcgtcgtcaagcacgccgccctcttcacctccaccatcatgggcaaggtgctgcagctacccaacgtcaagctcttcaacgccacctgcgtcgaagacctcatcacccgcccctctgccgagccttgcgcatcgcgggtgtcgtcaccaactggaccctcgtctccatgcaccacgacgaccagtcttgcatggac

SEQ ID NO: 684 - DNA, 280 bp, Trichoderma reesei
cgagcggccgcccgggcagggtcaaaactcgttcctcagctgcgaaaggagtttcagaaactggctggcgccttgatcacggagcacggaaaggacatccagcatgcgcctgactctaatccctccagcggcttctctaccccgagaacccttcctcagcctgtgccaaagtgtggaacctcaacctctacttctcacaccagcagctccgggtcgtcaacacggtgacagtgcgtgacgaccaggagtccgcaccactgccgaggagctgtatcagaca

SEQ ID NO: 685 - DNA, 141 bp, Trichoderma reesei
ttcctattgtcctgctggctccagggggtcacgtcagcttgaagtcgtgtctggacctgggcattacgtcctacatgacgatgccctgcaaggctcatcgacttgaacaacggcatgatccccgctctcgagaacagggcc

SEQ ID NO: 686 - DNA, 415 bp, Trichoderma reesei
gcggccgcccgggcgggtcttctgaggctgagacctctgccggccaagctgaggctccccctaaggaggacacccctgccgagggcgctgctcctgctgaggagcccaaggttgagtaaagtcagtcaggggaacgggggtagatctatgggctttggtcgctttggtatgggatgggatggtgtctacggaggggatggaagacttcgttttttgatcaagagcttcggcatcgtttaggtaaacacgcaaatcactttcggggagagaaccagtttggttccccccttatcaacggatcggcagggaggattgaagaagagcatattgaaggttctgcttttagactcttgatgcgcaccgtctggacaaaataaaaaactacgaaaattgctttataatataactttatctt

SEQ ID NO: 687 - DNA, 155 bp, Trichoderma reesei
gcgtggtcgcggccgaggtgggaaatggacggaagaaggggacgtgctccggcgtctgtcagcccttttctatttattgacgattgcatggaaaacctacctaagcttctttgacgataatgtcagcctctgcatgtacctgcccgggcggccgc

SEQ ID NO: 688 - DNA, 475 bp, Trichoderma reesei
tcgagcggccgcccgggcaggtgagctctccgacagcaccgttagggacctcaagaagcaggagctcgccctcaagcgccttgtcaccaaggccatgtcctcccgataaatgcaaatcgcttagggagcgacgatagtagggtcatgaacaaaatatcaaaaccaaaataagctggatgtggtgggattccgggagttgggtgtggaaaacaaaattctgggcgactggtagcattagagaaatgctcaccggtctttagcgccttgggaagagcgctatcatgggaggacaaaagcacaaagcctcctatttccttgttcatatttctctctcaacatctgtgtccattctattgagaagaaccgaggcatcatgaagagtatatccttttctttttcattttcgcattttcacttgtcctcgacttcttgcatgggtgcaaataatgacatgccaaatagctttgggttcacg

SEQ ID NO: 689 - DNA, 312 bp, Trichoderma reesei
gagcggccgcccgggcaggtacaagctttttttttttttttttttttttttttgaggttgatgctttatatactgcctggttcactacctcggttcacgagccctctatcgtagcccaatcccctcatcacctaaacagactgtttagcgaaaatttcgtttcttggctttcacaaactgcaaagccagaataaatttttttcttcttgactcctttgtttcgtcgggtggatgttctgcctaggtagtataaggctttatcctaatcctgggcagccatttacaaagcaaagacctcggccgcgaccacgc

SEQ ID NO: 690 - DNA, 290 bp, Trichoderma reesei
gcgtggtcgcggccgaggtaccaatgcaattcccttagttctttcgggggacctctgcgatctgcaggttgggaggaagggtctgcttcagcttctcggccttgtcattgtccttgagcaccagagtgtagaggttcttctggcatcggaccttgaacttgatgttgtgggccttcttgttcttcttgatccgcgcggaggaagcgtccttccgacggcagatctcgatgaacttcttgatgtcagcgacctccttgggcattttggcggtaacctgcccgggcggcggc

SEQ ID NO: 691 - DNA, 129 bp, Trichoderma reesei
gagtccataggcattctcctggtgcatatcactattgccagggggggggcagggaagcacccagagtcgtcgtcgtcgtccccgtgggagacaagaggaagaagacgagagagactgtctcttttcctt

SEQ ID NO: 692 - DNA, 268 bp, Trichoderma reesei
ccctttcgagcggccgcccgggcaggtaccgaaaatgctgcgtttccgtcacagaacccgtctctcacgacggtgtcttcatccggggttgatgaacaccacaaatgctacccaacgaattcccagaacaatcaactaaagcacaaacagtcaatctaggaacccaagacccttgagaaaagccgtccgatcaaacgccatatcgccgctgccagtgcatacgccaccgtgaaggctccctactccttcaacaggcggccgtacctcg

SEQ ID NO: 693 - DNA, 52 bp, Trichoderma reesei
gccgaggtcagaagcatggctcaggatatagaaccgttctccatagctgtcg

SEQ ID NO: 694 - DNA, 310 bp, Trichoderma reesei
gcgtggtcggggccgaggtaccagggcaccctcaagaaggatctggcctccgcataaacgcgcgctccgccttactcttttcctttttgcgcgtcatggtcattgcattggtgtcggatctttcggttgccttgcttattttgggctgggtttggggctctcataatgggatgagcatgaagaagaaaaaaaaagaacgaatttcagctagaaatctgaaataccagaatgagattcctgttatgataatgggaatcccaacgcatgtccatgcccaagtagcggcgccaatagacaaagctgaccagtt

SEQ ID NO: 695 - DNA, 253 bp, Trichoderma reesei
gccgaggtactttagtagcaacgttgcttgaactatcatacaacttcaaatgcattctgtcaagtccaaggattcaaagtatttatttctggctaaatcgctcgcatatggtggcgtcatgaggccacaggaaatcgtccaaccccgccatatttccgcaacccctccccctcttacttgcgctcccagctgccctcggcgtttgcgggaagcaggatgggcttcatgttggtgaagttgggaacatcgttga

SEQ ID NO: 696 - DNA, 340 bp, Trichoderma reesei
gcgtggtcggggccgaggtacacctcctcctcacgaagctatcgactgtgccccccctccactacccacccctaaccaagacaacaccctcattccttcatcagatctcctttccaactcatagtctacactctcctctgcagactctctacaccaagctcatgaagcgattgggctcgccacaccaagcacatacgaccataggtagtggagaattcggggtctcgtctgctcccccagagacaagccactaaccggcagattagtagccaggtgggtgaccactggcgaacaccggctgttgtatggtttgttcccttttttgctctttctaatttat

SEQ ID NO: 697 - DNA, 333 bp, Trichoderma reesei
gcgtggtcgcggccgaggtactactggctattacttcatttgttgcacatggaagcggggccgcactggacggcggggtggggatagggcttccttttccttttcctttctagatcaacgagcagcctgctttctcagcatcatcgattcgattcttctgtttcccctttttgagggaagtgtattattatcaagaaaggtccaccagactggattctctatgcacgggccgttgcattgggacgtcgaattagactttgctttggcagtcatgagggcatgggcgcacaaagcggcctgagcaagagcgggttgcgaatgaagaagcctgtc

SEQ ID NO: 698 - DNA, 240 bp, Trichoderma reesei
cccgggcaggtcatggagctgtggcggccaagaaggaggacgaggacaaaaaggagaaatgagacgggggatgattggaatgatgcatgggagacgataacaatgtagctacgaattttcatagcgtgtggttggatattgaatggatgactaggagtcgctgagaaggtcatggatggttatggcatttgtttgggtagattgatgcgcaatagaggacaggctgctttttttcctcct

SEQ ID NO: 699 - DNA, 209 bp, Trichoderma reesei
gagcggccgcccgggcaggtacttgtcccaaaagggatgagcgaggaaatccagcccaacaagggtagctccgcgttcgaaaagcacaagagggtggccatttgtgagtgcagagatcgggtttctccgtccccagagggaacaacggtaggagcacgacgcaaggttatgggacgaagagagcacatcaacaaagtcatccgacacgg

SEQ ID NO: 700 - DNA, 216 bp, Trichoderma reesei
cggccgcccgggcaggtactggttcaagacgtaggtcaatttgtccgaatcgctgcacatgctgaaagcccataggcgccggtggaagtattgccgttgatgccgttgcacagagactgatccgatccgcacacatagtcgaaaatgctcccgtaatcgctaggatctgtgctgctggatacgacgcactcagaggccttgaccatgcagctacag

SEQ ID NO: 701 - DNA, 253 bp, Trichoderma reesei
ccctttgagcggccgcccgggcaggtacatagctccagcagctccagcagcttcagcagcttcagaaacaggctttttgccggcttgcactttcgttatctcgaacatcgtcatcatgtcttctcagccgctccttcagaccgctcctggcaagcgcatcgccctccctacccgcgtcgagcccaaggtcttcttcgccaacgagcgtacgttcctgtcatggctcaacttcaccgtcatccttggcgccctg

SEQ ID NO: 702 - DNA, 224 bp, Trichoderma reesei
gcgtggtcgcggccgaggtactcggcgagataatcctgaccattgctgccttccggggcggtgacggtttgaatcgtaaaatcgatgagatacgtcgcatcgcggattgcgagagaaaccagatacgtcttgtatccggatagcacggctgagataccgataaagatgggtgttagagcaaggccgaagcatccttctgcctggacgaccttttcggcttgaga

SEQ ID NO: 703 - DNA, 187 bp, Trichoderma reesei
cgaggtcgagaaggtatcagggcgaatgcgggggacatgtctgcgacggatgttttcaggtttcttctcttatgagtctcggtgtaagactgagaatgacgctgtaacgacgcatgctttcatctaccaatggggtcatatactcgatgtctataacgataatgatatgagcaacttgaattatgta

SEQ ID NO: 704 - DNA, 295 bp, Trichoderma reesei
cccgggcaggtacagcatgttccatcatcattttctctaagccggatattgtgtcaagaagaagatggtggggatagtagtgaatgggaaggtgaataagatgaagtgggagaaaaagaagaagaagcaatcggcgcagaggatatgctcggatcagacttgatctcagagagcctctttgcaatctccgccgtcgagctctctgtagatgactttgaggactgattcttgcactcgagacactgccgacactcgagattccgccgcagctgctccacctcgggcgcgaccacgc

SEQ ID NO: 705 - DNA, 152 bp, Trichoderma reesei
tcgagcggccgcccgggcccgtgtcaaagtcaaagaactcgtcgttgagccgcccgtcgacgtcgggcggaatgaagcacacgttggcgatgccgacaatgttctggcacgcccgcagcttggtcgggtggtgcagcaccagggagtcgaag

SEQ ID NO: 706 - DNA, 143 bp, Trichoderma reesei
cagatccaaaacgttagaactggtattattgatagctatcagctgagtccgttagacctaacccaaatataagatacggctcaaggacaagtatcaatccatacatcttggccttcgagtatgtacctcggccgcgaccacgc

SEQ ID NO: 707 - DNA, 241 bp, Trichoderma reesei
gagcggccgccccgggcaggtacgagtttcggctatggactgtcttacaccaagttcaaactactcacgcctctccgtcttgtcgaccgcccaagtctggtcctgcgactggggccgttgtgcccgggagccccgagtgatctgttccagaatgtcgcgacagtcaccgttgacatcgcaactctggccaagtgactggtgccgaggtagcccagctgtacctcggccgcgaccacgctag

SEQ ID NO: 708 - DNA, 369 bp, Trichoderma reesei
gcgtggtcgcggccgaggtccgaattcagagttcctcttcacaatatggctaccacaaccatgcagcacaacccagtctttgaagtcctcgctatcatacaagcaggcctcgacaaatttcccaatccaagcgataaccttgactttacccaatgtcgtggattggtgaataaaagcacaaatcagtgtgaaaacaagagctgcaagaaaagtgaaagggaaaaggttaagagcctattctccgacttcaaacgcatggccgagtgccccgactcagacgggttctacgaagacatgcagttctttgtcacctacacgcattgctccaagcatcgcaaagatgtgtgtacctgcccgggcggccgctcg

SEQ ID NO: 709 - DNA, 370 bp, Trichoderma reesei
gcgtggtcgcggccgaggtacaaccgcaacggcctggccgggtttctcattgcaaacttgctgactggcttggtcaatatgacgatcccgacgctggatgcgacgccggtcatggccatggggattctcttggcttacacggcgactgtgacgggtgttgcggtgctgcttgacatctacgacatttcgatcaagctgtaaggacttggcaggacggggatgctttatcctaaaaaacacttccacggttgagagatgcgattattactgatgcacctgatcaaggtgtgcgtagtaagcaaggaacaatggaatgattcattggcagacaacggacatgtctggatgtgtacctgcccggggcggccgc

SEQ ID NO: 710 - DNA, 427 bp, Trichoderma reesei
tcgagcggccgcccgggcaggtggaggacaacgcataaaagcccccccatctccgctcattcgcgtggccccccagaatcgccatctttttctactcattttcgtggagcaattccccttcgtccctcttcgttctgtgtcgtctttctccctcctcttctccattcattccttgaccctactttttttccagagctaatagagagttttactgctattccttctcttctcttctaattctactctacaacatcattcaacatggcccccgcagctcttgagaaggaggacaaggcgcgagatgccgccttcaacaaggccctgcacggcaactcggccaaggccaagggcggcattgctgccatgttctccaaggcgccgatgccaagaaggctgcggtcgacgagtacctcggccgcgaccacgc

SEQ ID NO: 711 - DNA, 174 bp, Trichoderma reesei
caaagagaactgaagggaataggagggagcaagcaaagggacggtggacttcaacgtgagagtccgaattgtctcagggtatataaacaaataaacagtatggattttgttgcttttgttgcctttggtgcctttgaaacggacgtcgcagtgcaatttgaacatcgccgtgtt

SEQ ID NO: 712 - DNA, 254 bp, Trichoderma reesei
gtcgcggccgaggtacaatcagatacgcccaccagaaacgcttgcaatgacgggcaaccgtatgcttcttgggcttgggcgggacctcctgataggtcctgctctcggtctgagtgacatcaacgccgtcgttctcctgcttgtcagacattttccctgcctttctgctgggctgtagaattttcagtcgctgaacgttgcagaattgtcgcgcgtgtccgtattataggtgatgatgtcctccgtatgtgatg

SEQ ID NO: 713 - DNA, 380 bp, Trichoderma reesei
tcgagcggccgcccgggcaggtatttttgattagagatgcctacgagattcactcacggattacgaagcgaacagactatataatatcagggaatgcaaaaagcagaagcagcttggagagaaaaagttacgagaggaaagagaacgagaggaaacgaaacgagagaaggtggagcgagaggaggatggacatgaggagagggggaacgggaggaagtgaaggcgcataaagagattcggctggcgatgtggtgtttgtctattcttgattgttcgtttgggttgttttgacacctaataatggttggcgtcaggagggaaagctgcatggaaaattgtcatgtttcagggcctgcaaagtacctcggccgcgaccacgc

SEQ ID NO: 714 - DNA, 691 bp, Trichoderma reesei
tcgagcgggccgcccggggcagggtcgggctttcgtcgacaacgggcttcgactaccaagggtttcaagcaccaagcaagggtttcaaggcaccaagcaagggctttaaggcacaagaagggctttcaaggcaccagcaagggtttcaaggcaccagcaaaggcttccaaggcaccaagcaagggctttcaaggaaccaacaaaggctcctcttccttcaaaggcgccaacaactccaaaggtaacaagaacttgaaaggcttcttcaacttcaaaggcaaagaagttccaccaaggtttcaacaaacgtccaaggtttccagcacttaaaaggggtttacaatttctaaggcttccacaacgttctaaggtttccacgactttccaaggtttccacgacttcaaaggcttccacgacctcgaaggcctctcgacctcaaggcaagcagctcaccaaggcttccacaacgtcaaagctttccagcacctcaaaggcgtctacaacttccaaggccttccacgacgtccaaggcttccacgacgtccaaggcgtctacaacttccaaggcttccacaacgtcgaaggcctcctcgacctcaaaggcaagcagctccaccaaggcttctacgacgtcaaagctttccagcacctcaaaggcgtctacaacttctaaggcttccacaacgtcta

SEQ ID NO: 715 - DNA, 587 bp, Trichoderma reesei
tcgagcggccgcccgggcaggtctacccgtgcgcaaagacgaaccaccacaatgggcgccatctactacctaatgcacccgcgcgaactgcgctctatcgcccaatggaagttgcggcatgagcccgtcaaccgccgtgaccccaaaaccgagagtgcgacactacaagaatgtttccgcttcctgaacatgacgagccgtagtttctcggcggttatccaggagctcaaccatgagcttctggtccctgtcaccctcttctacctagttctacgtggtctggacaccattgaggacgacatgaccatccccctctccaccaaggtccccatgctgcgagagttccacgtgacaatggaccaggacggctggcaataccatgacagcaaggagaaggacagagagctcctggagcactttgactgcgtcattaccgagctcaagaagctcaagaagccttactatgacatcatcagggacatgacgttcaagatgggcaacggtatggccgactacgcgcaaacaccgagatgatccagaacggcgtccaacaatcgaggagtactcggccgcgacccgctaaggcg

SEQ ID NO: 716 - DNA, 247 bp, Trichoderma reesei
gcgtggtcgcggccgaggtacttgataggcgtgtctttgttccttttgtattcctctgtcctatactatatgtttcctttcctctttttttgttcgtgcatcaaggcagtcaattgcctgtgttgttttcttttgtctgtcggttaccctggatggtggtaatggatgccaagtagagcatgtgcgaacctgtaatcgagatgcctgttaaagcatttctgagtgaggtacctgcccgggcggccgc

SEQ ID NO: 717 - DNA, 267 bp, Trichoderma reesei
tgcagaattcgcccttgagcggccgcccgggcaggtccagatcctgcgcctgcaacgttgcctggcttcctcgacgaagagagcgtctttcttgtatagaactctgcccgagaaccattttatctccgaatcctgcgaaattccccgcgagagcttggcgcacacgataccttaaatctcgaatcctcggatctcttccccgtctccccgcgggttccagtcctgattatccttcttcaagatgtcgcaaacggctgtcgacttgaa

SEQ ID NO: 718 - DNA, 382 bp, Trichoderma reesei
gcgtggtcgcggccgaggtacgctcccgcatcaaccatcgaccgctcgcagctcaggagaaacagaaagccagctccaacattaggctcgtcgaccccgtcccgcaccactgggaagatacagtaaagcaagaccggcttgcccgccggcattatgacaagaggcataagggggaaaacatctggtttaccttctttcgcagtcgtccctctttccctagagaatccttactccatgacggtgatgggcctgcagaaccatgcacgcaaccaagtaaccctgctcgcccgtgtccgctggcgaaagacgcaagacacgcaaaacgagacaatcaaattccaaatccccgagatagaaaaaaaacctgcccgggcggccgctc

SEQ ID NO: 719 - DNA, 435 bp, Trichoderma reesei
tctgcagaattcgcccttcgagcggccgcccgggcaggtacctgtatagcccgggcaacaaggtgcgggtgcccagcgacatgatggagccgggcgggaagccgtggacggcgccgaacattgatatcggtgaaatcatctaaagcgctagttgctgaaggtggggatgatattcaatcccccttccaaatgagtcatggaatttgggaatggaatctcagggaatatatgtgtgtgtgtatacatgtacctcgggggcgacaacgctaaggccgaattcccagcacactggcggccctgtgattagtggggtcgggggctcgggaaccaaggcttgaatgcataggcttggaggaattctataggtgtcaccctaaaaaaagcttgggggaaatccatgggccataagcttgtttccttggtgggaaaattttt

SEQ ID NO: 720 - DNA, 233 bp, Trichoderma reesei
gcgtggtcgcggccgaggtacacaattccatcggcgattaatacacagcggcactggaacccccaagatttccgcccaattttgttcgtttgcctcctcctcctcctttcacccgcaccatgctattcactccctttcgaaactaccaaaaaaggaaaaatctctctatgcgccaagagccatctgcttcttgatctcggcaatggccttgcccgggttgagactttggggca

SEQ ID NO: 721 - DNA, 400 bp, Trichoderma reesei
gcgtggtcgcggccgaggtacagctcaccaaaaacaaaaagaaaaaaataaaagaccccagaaaacctctatgcagcggcgcgggggtgtagtttcagatatacactgcctttgcagtctgtggtgtctcattacgcctctcacggctttttttgcgtctccaagacgaccagattttgttcgccccaatgccaccctcactcgctctttcagcatgcatctctgctttgctcaaccctcctccatcagccctcgctttggttcggtcaagggttcgccttggagatctttagtaggtatttctcgaggtcaaactccgggctgttgacatccagggcggcatcgttgtctgatgctgcggccggggccttcttcttcgcgtacctgcccgggcggccgc

SEQ ID NO: 722 - DNA, 169 bp, Trichoderma reesei
tcgagcggccgcccgggcaggtacttgttggcgcaaatacgggcggcctcgagggcctcggagctcagctgctcatactcgttggagacgaggtggatgcagagagggaagtcgtcgacgttggcgcgctttcggcccagatcgaagacctcggccgcgaccacgctaa

SEQ ID NO: 723 - DNA, 266 bp, Trichoderma reesei
gcgtggtcgcggccgaggtaccgctggaagactcggatgaaccgcatgtcccagcacgaccgagttcgtcaaattgctctttatctgctttgctggggagaagcgaaccaggtccgattcatgccagagctgctctgcttcattttcaagtgtgcgcatgactacctcggctctcccgcgtgccaggctcaaacagagccagtggacgagttcaccttcctcaacaacatcatcacgccactgtacctgcccgggcggccgctcga

SEQ ID NO: 724 - DNA, 469 bp, Trichoderma reesei
tcgagcgggccgcccgggcaggtactccaagatcccgttctgggatctctatcaacaggcacgacgggacttttctgtatcgagagacatccttccgggtgcccccgcaaacctgctgtcgaattacatcgagttctcggttgcccgactatggcttggcgaacaagaaaaattgactgctaggcgttgtctccacgagatctggtcatacatccgaattcatctggaattacacatatctctgcagagactcatgctgattccaagcagtaaatggctccccagcccgtcctggtttatccccttttctgaagagtcgccgattgtcgctccgcggccgctcgagagtcttggcctatcatccatcctgcaatgggggggtggtcttctcatatccaatggcccattcatcgtcttcgtcgtgactcagcgaatggttcgtgattggaaaccgcatatatggggccga

SEQ ID NO: 725 - DNA, 344 bp, Trichoderma reesei
gcgtggtcgcggccgaggtactgccgtggtgtagagagatggaccgagccacgtcatacaggctgcctcaagtggcattcgatatttgagaggtttatttgggaggcgatggctggcggtatatggatgagtgttgatgaggccacttgcagcatgatgccaggataacagccgctcatccaatgaagcccgggttgcatttgtaaaccgagatgctgggtgactattgggctcccaggggtcgtagaagagaaggttgacgttcgagggctcgagggcagcaatacccagctgcggataccgatcctgtgactgtccaactgtacctgcccgggcggccgctc

SEQ ID NO: 726 - DNA, 191 bp, Trichoderma reesei
tcgagcggccgcccgggcaggtacaggatccatcgagcttggtattgcagctcttcatccgtcggcacatgccggttcgggttattcttcgacatggtagaagtaacccatctcttgagctccttttccagccttctataacagttggcgtcgttgaggaagacctcggccgacctcggccgcgaccacgc

SEQ ID NO: 727 - DNA, 447 bp, Trichoderma reesei
gcgtggtcgcggccgaggtaccccagtgccgcccatagaaacaaccatcatgccattaactagaacattgccaccattacgcattatatcaagcaaatcaagcgtgaaaagaagaaagcctcccatactgtgtcccattctgtaaacatgtggcctgttaaaatatgtcgaagaaatgcagatacagacccatgatgcggcaaacctcaatgtgaaaattaaactccataccgccataaacccaatccggttggatagtcacgatgcattagtgacagcggaaccattctggacctagaaatcgtctggcatatacatgtcgtcgatgatctctttgtcgctatcaccggagttgtcaccggccacctttgctggttcttttgctgccgtgtagatgtatttgacatctccgatatttgggcgtaaggcgtcgtacctgcccgggcg

SEQ ID NO: 728 - DNA, 489 bp, Trichoderma reesei
gcggccgcccgggcaggtacgaggcatgcttctcgacaatgggccgtcgcgcatacagattgttgatctcggatatcgcagtcaatgcattgagaagaatggctacgaacaagaccgagcctttggcgtagaagccatctgttgtgttgggagtgccgtagaagatggaaccaataataagagccatgacgatctgaaccactgtggatgccatcgttgccgatttgttattccatatgcgctggtaggcacgttttgtgttgaacctgatctgcatggggatgctgatgatgtatggagacttgggcctcatgttcttggcctgccggaaattcttctgctggcggaaacgcgcgagattctcttcctggcgctcaccgccgaattcttcctcgtattggatcgagatctttctgcagagcctcgaattcaggagactgcagccacattcgttcgaatcttgcggagtccgaggcacctttaactcca

SEQ ID NO: 729 - DNA, 226 bp, Trichoderma reesei
atcaataagacaagatcatcctctattagtgttccagtctaaccgccaggtaggacgctcttcgcaccttgatcctgcccgccatgcagcagatccacgacaaggtcgactttaagctctcctacatcggcaagtatgtcaacccccctcaccctgatgttgcatcgaaacgcccatccgtgtatacatacccatgctgacaccgagccaggcccactgccaacgg

SEQ ID NO: 730 - DNA, 473 bp, Trichoderma reesei
tcgagcggccgcccgggcaggtaccaattacaggcacagttaataatgaagataataacatcttgtataagatattattttaaaactttaaattataaaatgacacctatggacatgcgtttcatggctataatagataaaaagagcgtattttttaaaggctagagagtgaattaccctcttactaagaaaatataagcactccatattgtttataataaatacatatttagaataaacttatatttataaagaagattccaaacatgtataataaagatggaattaatattataaatgcaaataaaataggtaataatacagttcaacagaatgacattaattgatcaaaacgtattctaggaaaagacgctctaactcatataaaaacaaataccattattgaactttttatacctaaagttatactagataataatccatctacagaagagctagttatattctcttat

SEQ ID NO: 731 - DNA, 480 bp, Trichoderma reesei
gaagcggccgcccgggcaggtaccagcgcagatcgactcccatgacgcgagagaatctgacgagagcatgcctcatcaaagcgacgcctccaccttggggagtgctactgaagaacgcaatcttggtcttgtgcttccgtagagtctttgcataatgcatgactgtctcccaagacgcaaaactgcaggtagtcttgtaatcctcgagagagatgagcggcgcctggaacgatgcatcgacttcgacaatgccgcgccacgcgacttgtagaagaggagacagtgaagggccaaaattcataatgcattttctcgccattgaatcggcttgttcgtccaccgcttgctaagccagagggctatcctctctgtatgctcatgaggttgctgaatgacgatggggacgatatccaactccagccagaggcgcgagcagagagacgggcttgttgttttcagagaactgggaaatccagcgcc

SEQ ID NO: 732 - DNA, 194 bp, Trichoderma reesei
gcgtggtcgcggccgaggtacaagcttttttttttttttttttttttttttttttcggagagccgctgcagacaagcttctggactttcattctgtagttcaagttccatttaacgccaacccagaaacactaagcgggtattccttcacgattcgcccgccatatgtcgtgtatcatttgttttcttttcttt

SEQ ID NO: 733 - DNA, 374 bp, Trichoderma reesei
gccgaggtacttttgtagcaaagtcgagtatgatgcatactcgggtagtttcgattgcgcaatggtgtgggatgaagggggtatttgatctggtgtagtcttgttcaacgctttggcctccccgcgttgttcggctaccttttcgctttggtaacgctgtttattcggcttgcctctctcctattatcgatgctcagagggttgagcagagcgctgattttctacgcctggtttatggagactttgccaatgactgccactccacgctgcaggtgatggaagcaaaagaccaaggcagggcgccagccatctgttctatgctctcaactctcaccatgctgctcaacctaatcgacctgcccgggcggccgctc

SEQ ID NO: 734 - DNA, 355 bp, Trichoderma reesei
tcgagcggccgccccgggcaggtacatacagcgttcgagctctggtgcgccctgggaggctgttttgcgtgtcccgcgtcgagaatacccaagcccaaacggacaaaagcccgggatgctgccgactcgggaagctgtcgctaccactgggatacgcactgggacatcatcaagaccattccatcacttcttgacgccctcaggtctcggactcaagatcaagagctctccatacaagccccctggagccagcagggagaacaatgacaagaagaatcgtttcaaaaaaaaaaaaaaaaaaaaaaaaaagcttgtacaaaaacgcctgaacagccagctgatgctttccaatgac

SEQ ID NO: 735 - DNA, 376 bp, Trichoderma reesei
gccgaggtacggccccgaggcgtggccagtgctggcagcaggcatgccaacgacgcggagggcatttacgtgcagatggactttgagctgaaggaggctcgggtgaatacgaacactacgacgccgagtctggatagccggtgagggaagggacaaaggggtgatgtttttctgatgatatgtttttgtctgatatggttgtttaggcggcgattgttgcggcttgtcatagacctctgatgtttacgatatccaaggttttgcaaattggagggcggatgaatgcgttggccttttttttcctttctttttttcttctttttctccgctggtccttccttgttgcaaacaaggcttctgtcatagacattggcgc

SEQ ID NO: 736 - DNA, 245 bp, Trichoderma reesei
gcgtggtcgcggccgaggtactcgtcttcattgaagccatacgcgcgcttcatccgtttgacatcatcggcacccaaaggagctccatgagcctctgcttgtccggcaacggcgctgtccagcccgatgattgttttgacattgatgaatgtcggcttgtctgttgaagattttgccctttctaatgctgtcacgattccatccacatcgtagcatccatcctcgactgaaatcacatcccagcc

SEQ ID NO: 737 - DNA, 458 bp, Trichoderma reesei
gcgtggtcgcggccgaggtcgaagctggttgccagattgagcaggatcctgaaatcaagcacatcattgtcatgtgcccacggccagatctactggttcgacgttctcgatgacaactcggatgtcattatgaccgagaaggacattgaactcaacctccagaccattgtcgatgatgcttcccagatccccatccaggatgcggcaaagaacgcccttggagtgctcagcaccgaaaaccgcaaggtgtggtctgggctacgagatatactgacccgcgagccgggttccacaatgccgattcgctcagcatcgtcgactctgccctcttcgtcctgtgtctcgactataccgagcccaacaccgtcgcggctctctgccagaacatgctatgtggaaccagcgaggtcaagaatggcgtccagatcggcacatgtacctgcccgggcggccgctcc

SEQ ID NO: 738 - DNA, 217 bp, Trichoderma reesei
cccccgagcccgaccagggcctatactctcgtgcggacggtcaaatcggcgttgtcaccttcaaccaataccaggtgtaaggccattggacgagtgtttgtttgactcggacccttgggtgacacggattcactggagtatattatctgcattttttgatgtgtgatagatttctcatgggcgttttgggaccagtacctgcccgggcggccgctcg

SEQ ID NO: 739 - DNA, 638 bp, Trichoderma reesei
gcggggtcggggccgaggtacccgtctcagcgaccgggagggggataggaaccatcgaccaccgccgcctcgccggataagggagagaggggatctgcttgatgacatgacttgcgaggcgcgggttggttctctggtccaaatcatccgtggctagagctcaacctgccaatccctggatcttgaatcgtctggctcttcccgcttcatcattctagaaaatctccccaggcaggcaccggttaagttgtcatggattttgcgcaaaaagaagatcgaaccccgcggaaatcattctagcctggatagcccgtctcttttctgcttcttctctgcggctatttctcctcttagcctttccggatcctggacgataatcatcaggagatgcgccaagtttgacgttttctttttgcgccatctccgggcttcattttcttccttggacttcttcaggttgcatgtcgcgtctccaatcatctttttgtttttctttgaggatttttcctttgctttgcttttctgattagcaaatgatgcattgctttttctgtgtcggatgggtcaaataccgagcttgttgcccgctacgatgatagccttggatgaataacgcctgcatatgtttcatagcactg

SEQ ID NO: 740 - DNA, 214 bp, Trichoderma reesei
gagcggccgcccgggcaggtacaatcaggctcgccatggcatagacgagaaagccaagagaagtatgcggccgatctccccggacgatttcctcccagcagccgtgcgtagcgtttgtaggaaagtatatgtgggaagaggaggtcgagcgagaaacggcccgaaataagagaaaacgtcgtcaacagtcgccagtacctcggccgggaccacg

SEQ ID NO: 741 - DNA, 274 bp, Trichoderma reesei
cgagcggccgcccgggcaggtacaatttatataccgaaaaccaccatcaacccaatcttgcatctgattcaagcgtgaaaaagtcacccaagattccctcctagatccccaccactgctcagctccgcttctcctcctcaatctccctccgcagctgctccagaacctgttctcgggacctcaagtgcgcctccaggccgtccacctgttcacggacagtctccaagtcggccgatatgctcttcaagttaccgcacctcggccgcgaccacgc

SEQ ID NO: 742 - DNA, 508 bp, Trichoderma reesei
cgagcggccgcccgggcaggtacaagctttttttttttttttttttttttttttttaaaaggaaattatctcgatgatggcaagcattgaccctgatgcaaatgatttccgaggatctaacctccaagaactccccacgatatcccccctcacgtcccatttcttcatgagtggacccatggtgaggattgcctcacgttttttagactacatgccgtgttcttaattgcgccatgcatcataagatttgttaaccccgaaagagacagattcgtttaggaaggaggagcagcaccacgtccacggccaaagccaccacggaattgaggagcaaactcgccgggagcaccaccctccttgccctcgccagcatccctccttcggtatccaccctcacggtcgccacggtcgccgccacggccacggccgccaaagggtcgtcgctcacgctcgccctcgccgagcatgccacggggaggagcgtgtgatcgctgctgcttgatgtggg

SEQ ID NO: 743 - DNA, 163 bp, Trichoderma reesei
tcgagcggccgcccgggcaggtccagcgcccagcccggcggcgacaccatctcgtcctgcccgtccgcctcagtctacggcggcctcgggaccatgggcaaggccttgagcagcggcatggtgctcgtgttcagcatttggaacgacaacagccagtacatga

SEQ ID NO: 744 - DNA, 314 bp, Trichoderma reesei
tgagcggccgcccgggcaggacaagctttttttttttttttttttttttttttttttttttgcatgaatcagattgtttttttattatttcgttgtcccttcgtgttaaatcatctcccgcttgtgtctccagctatgaggcgttttaggtatatatgtcatgcaccgagtgaaagcaaaagattggactcgtaaccttgtctcttttttcctctcccccaacctgctctgacccgcatctttgtttgaattgaaagaagacgggcacttagaccttcatctcggtaagaccgtgcttccagacaatgacgtag

SEQ ID NO: 745 - DNA, 175 bp, Trichoderma reesei
gcgaagtaatattgtcgataaagacaggttaatactttgtttatgttgactgtcacactctcctcatcacccttatcgctacatgcagaagaattggcatgtttttgaaatgtcaaaatctcaagtgaaacatcattgagagacgtccgactcgagattatgagtacctcggccg

SEQ ID NO: 746 - DNA, 266 bp, Trichoderma reesei
gaggtaccgtaattgataccctctgtccaactctcgccccaatgtaacttcctttgcttgtgcaggatcagacatctatcgtgttttcctttgcctgttccctctttctgtgtgaccataggaaattcatcataattcatcaacgtgccgtctcactcaaagcttggggtccgtctcttcgaattcggcaatgtccttgacggggcgagctccagagcttgctggcagtccggccttgtacctgcccgggcggccgctccaaggtt

SEQ ID NO: 747 - DNA, 329 bp, Trichoderma reesei
gcgtggtcgcggccgaggtccgagagccatctcaactggttcgcctcgcatctcgacactcttgcaaaggacgagcgtgtagagctccagctctacgttacccggcctttggagaagaacgcggacgacgggctaggcctcggttcggcttccgccacctcgccgcccgaaaccgacgtcgagaaggccgttgcggctgttacggccgagccacttgtatcctcctcttcctctgcctcctcctcctcttcatcctccaaatccatcgcagacgaaaccgattcgacgcaaaacaccgccgccgcagagacgcagccgcatgcctacag

SEQ ID NO: 748 - DNA, 494 bp, Trichoderma reesei
gcgtggtcgcggccgaggtacaagctttttttttttttttttttttttttggagacgtaattgatgcttttttcttcttcttaccagaactcattttactttaacaatgcaacttgtttcaaatcgctctccagctttgacacttcctcgctcacagactctgcgcacttgagcgtatataccgcgcctcgctgagccacatcaaccagcttatcgactctccctccctgagcgagtccagacaccaagacgccgaggaacgtgtctccgactccattgacggagacaatgttctccacatgctcgactggtgggaacaatcgcatgtagatgccgccaacggctggatttccgtcataggaccgagtcaagatgaactcttcagattcacggtcccgaagtcgaggatcgtctttacccaagatggttgtcaacagaacgcccttggatccgagctttgtgatgattgtcggaatgtaaggcagcactggata

SEQ ID NO: 749 - DNA, 397 bp, Trichoderma reesei
ttcgagcggccgcccgggcaggtactaaagatggattggaattcttccgtctgtctagacgacccggctcggaagtcacttgctcggtgtcgacccggcaattgttatgaaagcaccctgacacccgtcataaaaaaaggacttttaaaaaagaagactgaagatatgaagaaggcgaggacatatggataccagcgaattctctttgtttacttttgtcttatggatgcttgttcttatgagcgaatgggggagagtccattgatcatgataccacaccagggggggcatgatagtctacaggtcgctcgtgccgggacctgaacgactgtcttttttcccctttacattacatatacctagtgcttaatactgtaacgaccaaattttatatatc

SEQ ID NO: 750 - DNA, 154 bp, Trichoderma reesei
tcgagcggccgcccgggcaggtaccatcgaaaataagccctagatactcgagaggtagctcgtataaatattgactcctgagggcaaagacgcaccaatcggtgaggtattcatgtaaacgactcgtgcatttgtacctcggccgcgaccacgc

SEQ ID NO: 751 - DNA, 185 bp, Trichoderma reesei
gcgtggtcgcggccgaggtttgtacaagctttttttttttttttttttttttttttttttcctttctttttttttttttttttttttttttttttttttttttttttttttttttttttttttttttaaaaaaaaaatttgggccttcccgttttaaaccctagggtttttttatggaaaggggg

SEQ ID NO: 752 - DNA, 449 bp, Trichoderma reesei
tcgagcggccgcccgggcaggtacctcgtcaacattgtgaacaatgacttccgcgagaacaacaccatcttcgccctgctcgaaggcctcgaagtcaaggacctcgccgtccccgcctccggaccaccacctccgcctccggaactgcctaagctgccctcttcacatctctcactgctttttttttctttgcttttgattatcatttcggcgcaaatttcattttctctttaaacgcggcgtttgattctttctcgggtctttttcacaaaaagctcacaccgaaggcaagtattactatttgaaacggggacgtggttttaaaaacgctcccggcggcggcgcaacgggaacagtggacaacgaagaaaacccgaaaataacgaaatctggattttgctttgggagaaaaaaaagaaagaagccgggtctacatttggaagattgca

SEQ ID NO: 753 - DNA, 78 bp, Trichoderma reesei
ccatagctcgccccctgacgagcatcacaaaatcgacgctcaagtcagaggtggcggaacccgctagcaggtccgagc

SEQ ID NO: 754 - DNA, 329 bp, Trichoderma reesei
gcgtggtcgcggccgaggtgtacaagctttttttttttttttttttttttttttgcattacatgtaatatacatatatatgtgcactattctaaacagcaaaagtctcgtgcaggatccaagtgctttgtaaaagatcttgaaagctcgaagatttgtccatggtcgtgtatcgtgtagcaacccaaaaacgctcttgagatactggagaaacctgaaaaaatgcttgttttggcataaacaatgaaatgaagaaaacaagcaaacgccagctgtatccatgcaaaaaacatgatatgaaaatgtgtatacacaagaatcgaatcgaag

SEQ ID NO: 755 - DNA, 158 bp, Trichoderma reesei
gcgtggtcgcggccgaggtacaagcctttttttttttttttttttttttttttttcttttttttttttttttcacgagggggaaaaaaaaagggcaacattcattctatgttttatgcattcccatttttgaaaaatttccagttcaacccatcaaac

SEQ ID NO: 756 - DNA, 296 bp, Trichoderma reesei
gcgcgcccgggcaggtacgacttctctccctttcaacaagaagacgcacacaaaaaacatggaaagaaatgcgttacaaaaacgttacacacaagtcgtcgctcttcgccgcgatatcttgaaagagacgggcgtaaataaaacagtcccgtgttcagacgggggccttttttttcttccttttttgtttttttttcctccctcgttttccttccggttcatctttcatccaaagagtcctcttcgtccccctttgggttgctcagccttttgcctcctaacaagtccgcaaaggg

SEQ ID NO: 757 - DNA, 426 bp, Trichoderma reesei
gcgtggtcgcggccgaggtaccagctgtcgtaaaaaaggacaagaatagattgtaataagacaagcgttaagagaagaacatgtagctccgtatctgacaatttctgaaaatcgatcgcagcgtgggtgaaaaggcgaatagctccatcctctccaagacaacaacacaacaacaatctggatccaagggcggtcgtatcaacacaaatgtttgaactcctcccctggcttccagactacctagtctttgttcggcaacgatgccatgtgcagttcgtcgcttccgttccgcagtctccggatcacgtcgtgctcgctttcacgatcgcttgacaggctccgtcggcttcttcgcctctcctcttgcgtcctcggtcatctctatgctccctcggctgctcctccgtactgcccggcggccgctcg

SEQ ID NO: 758 - DNA, 249 bp, Trichoderma reesei
gcgtggtcgcggccgaggtactgccaaactgccaacgaaacacacaacgacaaatcagcagctttacaggcctactaactgggtattgtctgtctgcttcacggcactataacccggccctcgttctgccagctagtctgcgcgcgacggcgttagtacgtatttacagtcgccgccgtcagctttgccgagataggagctccgtgtgagcatcgccacccgggtccgtacctgcccgggcgggcgctc

SEQ ID NO: 759 - DNA, 457 bp, Trichoderma reesei
cgagcggccgcccgggcaggtacaaaatatcatgatccgctctcagactccatggtgattaagggccaggtcgaatgtatcccaccaaacccatacatcctgctgctgtaagtcaattgtttgtttgggtttgtcttcattttctctcttttctcttttgcgcccagacactcgcatcagcttgacttgcgcctgttgaactcgagccgtcgaaaaaccctgcttctcccttgccttacaccattgtcgtgtcctctctctctcccccttgtatcattccaatcgccgtataacgtgtttagctcgagaatttgcggctgatcttggcaatgatgtgcagagaaacaacgctgaagatgaagaccagggacagaacaaggacaacaaagcactacgatgcgtagagagtggaccgcgcgctggggaatcagcatagtgctgctggaaccgccagcgc

SEQ ID NO: 760 - DNA, 217 bp, Trichoderma reesei
gcgtggtcgcggccgaggtaccttctcaacacgttgcatcactatcgagatctgttacatcccgaacgtccttatgttgcgatcatggggccgtgggttgatcctgcatgctctaaagtggcagcaatgcagatgcttcaatatatcccaacgccagccttcagtatatggcaccgcattccgcggttttttgtagttgggatgcggcaccctgtat

SEQ ID NO: 761 - DNA, 298 bp, Trichoderma reesei
tcgagcggccgcccgggcaggtacctcaatcaggctgggcgactggtcgtcgaatctcagattcgacactcttaccccatgtgccctcgctctgataccccgctcatctacagaactgtgccttcgtggctcatccgcattcccgagatcattcccagcatgctcaagaacattgaggactctcactgggttccctcattcgtcaaggagcgtcgtttcgccagctggatccagaatgctcgagactggaacgtgggaagaaaccgatactggggtacctcggccgcgaccacgctaa

SEQ ID NO: 762 - DNA, 412 bp, Trichoderma reesei
tcgagcggccgcccgggcaggtacaagcttatatatgtttttgttctttttgtttttatgtatttattgttgtttgctcgcattgtctaatggttttggggtaaccctccacgcaagcatcatgaagggataattccaagggataatctggccacagtacaccgagaggctcctgcaagacataggccagcttcttcggtgatgtctcaatcgtcttgcccgtgatcttatccgcagcaccggcgtagtatcggaagacgttgtagctctcggtgagatcccccgtggcatcggtaatggactttccattgtccagagagtcgatacttgccagcagcttcaagtccctgccaatcagttccgcaagcttatagatcaaggctcctcggtcaaccgctgcaagttcggacca

SEQ ID NO: 763 - DNA, 448 bp, Trichoderma reesei
gccgcccgggcaggtgtcaagttcggagagtcatatgtattcctggcgctctcattccgtgatccgatgagatacctctcgattatgcacttgcaatgccaaggtgaccacctcctgggtggtgacatcctgtgcaaaaatcagcccaagatcgtcctgggactcatgatcttcacggacatgattttcttcttcctggatacatacctcttctatgtcttgatcaacgcaatcttctccattgcgcgatcgttctacatcggttcgtcgatctggaccccgtggcgaaacatcttctctcgtctgccgaagcgcatctactccaaagtcttggcgacaacggacatggaaataaagtataagcccaaggtcctcatttcccaagtttggaatgccatcgtcatctccatgtacctcggccgcgaccacgctaagggcgaattccagc

SEQ ID NO: 764 - DNA, 210 bp, Trichoderma reesei
cgagcggccgcccgggagcccggtgtcattgtcgtcttctgcatcgtcttcgtcgttgccgttggtctcattggtctgttcatcgccaagcagtgcgccaagagcgggcctccaagtctcagatctaagcgacgacctgaggcctggggaagagggcgggttgagactagggggtgcagaaaggagaagttgacgagggtgagagagggg

SEQ ID NO: 765 - DNA, 266 bp, Trichoderma reesei
gcgtggtcgcggccgaggtacgagggtcccatggacgacgaggccgccattggtatccgtgactgcgaccctaagggacctctcatgctctacgtctccaagatggtgcccacctccgacaagggccgcttctacgccttcggtcgtgtcttctccggtatcgtccgctccggcctcaaggtccgcatccagggccccaactacacccccggcaagaaggatgatctcttcatcaaggccatccagcgtacctgcccgggcggccg

SEQ ID NO: 766 - DNA, 208 bp, Trichoderma reesei
tcgagcggccgcccgggcaggtactgggtcttgcagttgacctggttgtccaagaagggcatgatcaaactgcccgcagcaccgccagctcggcactgctctcgctcgtagcttccaaccgggtcgtaggagtagactgcacccttgccctcctcgtcaagaccaccgagcatggcatgcgtatagtatacctcggccgcgaccacgc

SEQ ID NO: 767 - DNA, 371 bp, Trichoderma reesei
cgagcggccgcccgggcaggtactccgagtcagatgtatctgtgcggacgatggactttcctcccacgattccgcagcggtcctcgtcactgtccgcccccacgagtcgcaacatttccagggctggctcagtgactggtgtctcggtcaccgccagcagtgtcaaggtccacgtcgccgaggtcgaggagcaggccatctctcgcttcagccaggaggtgcacatcatctgccctagcacgccgtcgctacctcccgcgtccccagagacgaagggcctggaaagggaggagacagcgaacagccttgggtcgaccagcacgatgatgtgctctcggtgaagaagattccactgcggaacacgcccttct

SEQ ID NO: 768 - DNA, 64 bp, Trichoderma reesei
tcgagcggccgcccgggcaggtacgagccatactcagcatgaaaacggcaatgcgtctctgagc

SEQ ID NO: 769 - DNA, 133 bp, Trichoderma reesei
tcgagcggccgcccgggcaggtacattggcgatgcttccagcaatcgcaatatgccccgaccaacaacatctagttgcaatatcccgggcgccgactcgcaccgaaccgcgaagccaaacaaaaacaattgaa

SEQ ID NO: 770 - DNA, 275 bp, Trichoderma reesei
ttcgagcggccgcccgggcaggtacgacaagtaatctattatcgagtttccgcaaccacactggattcggcttcatttggtttcggataaatattacatattatcggcacctagggaaacgaagagtagctatataaggcatttgcatctcaacagcagttctctatctctacattcgatggccctgctttctctgttttcccgttcacctacttcttttctgtctttgaattgcctttactctcatttcccttcctagagagtttctattgtgg

SEQ ID NO: 771 - DNA, 183 bp, Trichoderma reesei
cgagcggccgcccgggcaggtacaagctttttttttttttttttttaattgagcgatcaaaccgaaatgccatttgacattcaagcctcatcgacggctatatacctgtcatgacacgctgctgcgcagacaaacagcaacgcaatggacctgctcatgtaatatccccaacgccataaagaa

SEQ ID NO: 772 - DNA, 152 bp, Trichoderma reesei
cggccgcccgggcaggtaacagggcggttaccctcagcagcagcagcagggcgtctaccctccgcaaggttaccctcagcaggcttaccctcagcaaccccaagctagctacggtcctccccagggtcagtacctcggccgcgacacgctaa

SEQ ID NO: 773 - DNA, 347 bp, Trichoderma reesei
gcgtggtcgcggccgaggtacaagcttttttttttttttttttttttttttttttttaaaaataccgtaaaatctattttttcaatgactataatacccaagggcggtgctatataatccttggaggctctctcttctttttcttcggcttgtttttggggctgcatctccgtcttccgaaacacagcatctactgatcaggttggtcttcgggttgatgctcaaggcagaatgaacggatgatggaatccgtgtcgtcgatagcaaggggacggacgccggccatcgccttgatcttctgtgtaagtagcttggcttgctcgtcggtgatgatcagacccagctgg

SEQ ID NO: 774 - DNA, 138 bp, Trichoderma reesei
gcgtggtcgcggccgaggtacgccatgaacctcgtgagtcgctcaaagtcgaagggcgggggcaggctcttggagtcgggaatgaggtcgcggtcgaggaacggattcttttcgtcaagttcgtggatttcaatggcg

SEQ ID NO: 775 - DNA, 93 bp, Trichoderma reesei
cgagcggccgcccgggcaggtaccaattcttgcgccgaataagctcgagctctgcaggctgtatgactccacgatcaacaagacaggcaacgg

SEQ ID NO: 776 - DNA, 423 bp, Trichoderma reesei
cgagcggccgcccggcagtacggcttcgagggagaatgcaaggcaagtactaatagtctctatggttcttgaagatctcaagctggattccaagacgagcaccgaggtctgaaagctcttgtctaatgccagcgcaccattgttcatctgagtattgcagtgatagtttgaaactggtaaaccaaggggtttggtgcatatttccctcccaccatcgctgaagtttgttaaagaggtcgcgatcctgccaggcgattccttctagccatatgctgtcgtcattaatagtcaggtgatgcatgtttttgggcatcaggtcctcgaggcagtccacattgtccaccaaggagaatcccatcaagaagagctccggtatctcgagtctttgcagcctttcaaagttcctcaggcctttgagggaac

SEQ ID NO: 777 - DNA, 171 bp, Trichoderma reesei
gcggccgcccgggcaggtacttgccatctcgctccacgtggctgccgaagtattcatccacagtgcttggcgcaatgtcatcgtcgcggtccaagcagttttggacaatgggtagcagagccgattcgacagccttggaagcacggccttggtacctcggccgcgacacgc

SEQ ID NO: 778 - DNA, 63 bp, Trichoderma reesei
tcgagcggccgcccgggcaggtacccagcaagcatctctttgacaatctttttgtgtacaagc

SEQ ID NO: 779 - DNA, 184 bp, Trichoderma reesei
gcgtggtcgcggccgaggtgtgtccgcttagcagcacgattaagagggacgaagatggcggtggatgttatctaggcatgagacctcgtggttggaacaggcagcatttttaccttttcaatgcttacaatgccagcttggagacggtgccgtaacattatccccaggctgtttctctccttca

SEQ ID NO: 780 - DNA, 244 bp, Trichoderma reesei
gcgtggtcgcggccgaggtactctgacgggaaaaaccatcggacggcgtcggattcgtctgctaacttgatgagctgaaattgatgctcaagagcccctcggccaagacagctgatggcagtgtcgacgccctgatacgcgttcttcacgtctgccgagttggtgatgtcgcccacgatgaccgatacgcctgcatctttccatctagacaaaagttcaggcttattcacctgcccgggcggcc

SEQ ID NO: 781 - DNA, 225 bp, Trichoderma reesei
gcgtggtcgcggccgaggtacaccatccacatgcacaagagactgcatggtgtcactttcaagaagagggctccccgtgccatcaaggagatcaagtctttcgccaccaaggccatgggcaccaccgacgtccggatcgacccccagctcacaagaaggtctgggagcagggtgtcaagggtgttgcttacagaatccgagtacctgcccggcggccgctcgaaa

SEQ ID NO: 782 - DNA, 302 bp, Trichoderma reesei
gcgtggtcgcggccgaggttttttttttttttttttttttttttttcagataataggtctttctttgggtcaagattcatttatgcatctactacactcagagctgcattcgaactttacaagactgaaaacacatccgcgtcataaccgacgataacacctgggaacttctttggttcctctaataagtatctatgcatcaataatttccctttttttaattttttacaattcgtcgtggaagtcgccatcgtcctcggagccaccagcaccctggtacctgcccgggcggccgctccgaa

SEQ ID NO: 783 - DNA, 295 bp, Trichoderma reesei
tcggagcggccgcccgggcaggtactaactgatacccctttaaagctaggttatgattctcacccgtcaattgacggtttacctacctcagatactcagatacgtgcctgctcccgtggttcccatccgttgttacctaccaaaaaagaagagttcatgctacatatgccataacagacaaaggacaaacgccatacgctgtaaaataccctaagagacaaatgatgtattccgagacatgttgggtcgtggaggagacgtagcaggcaggtctgtacctcggccgcgaccacgc

SEQ ID NO: 784 - DNA, 147 bp, Trichoderma reesei
gcgtgggtcgcggccgaggtacaaggacaggccgcactttggtggattgtctctgtgggatttgtcacgtgggttttggtcaacaatatcaacggaacctcgttcaaccagtgggcgctcgacgcgctgcagtactgccatccgaca

SEQ ID NO: 785 - DNA, 268 bp, Trichoderma reesei
gcgtggtcgggccgaggtacgcctcttttggcttccacaatgagcgccccatcatcatcggcttcctcctcttctccgacgccctgtcgcccatggacacggtcatccagttcctcttgcacatcgtctcccgcacgttcgagttccaggccgacgcctttgccaatagcctgggcatgcgcgccgagtggcccacgtcgctcatcaagccgcacgtgcagaatctcagctccatggacgccgactggatggatgcgagctaccactt

SEQ ID NO: 786 - DNA, 73 bp, Trichoderma reesei
cgagcggccgcccgggcaggtacatcgtggacaatggccaccttgtggatggaataccagctacgtcttggag

SEQ ID NO: 787 - DNA, 362 bp, Trichoderma reesei
gagcggccgcccgggcaggtactgatctcgaattctcaatccttcaatcgagactctggggccctatagggactcaaggcgcaacccgcgaacccaatttggctctgggctctcacgaaggacattcattcatcatcagagcgtcttgtcagatgacggagttgtagtgttgcgttctcatagcaccagggtcgggacgggaactttcctcctcttcgcttcttctttcttcctaccctcgctcaccggcgctttggggacatcagacaggatgaagaagtttactttctcgaggccggcgcgtaagaagccacaggagcctccgccgcctgccattccgagtacctcggccgcgaccacgc

SEQ ID NO: 788 - DNA, 444 bp, Trichoderma reesei
ttcgagcggccgcccgggcaggtaccaacattgtccccaacggcccaggctttaccgatcccggttcgcaggcttgcgctggcgtgggcggcgcatgccggggcagacctacgtcgatggtgacctgtatctggaatcgctctcctacagccactccacgtctggcgaaactttggcatcatctgggcatggtgggttctgtttgtggcatcactgtcttcttcacgacaagtggaagagctcttcggaagcggaccagtttgttattcctcgagagcgatcaagctcgttctgctctacgccaggctgacgtagaaggccaagtttcggaaaggaggcaacaatgtcaacaacagtctgacagcaactcttccgacgacaccgcggggcagttcaggcaatcttatccgtaactctcagtcttactggagatctgtcctatac

SEQ ID NO: 789 - DNA, 333 bp, Trichoderma reesei
gcgtggtcgcggccgaggtacaagctttttttttttttttttttttttttacaggtcggcacgcaatagacattgtagagtgtcttacagaagaaagagacgagttgatccaacgccgcccagattcgttattgtagccgttggcttgcgtatccccttgagctcaaatcaccataccttatatacttatcacctctttataagctcagacacccgtatagagttccttcttccaagcccgagcatctacaatctgaaatcataccacgccaaggactggtggtgtattgccccatccccaatgctgctgcagaattcgcgaccctctccgcc

SEQ ID NO: 790 - DNA, 492 bp, Trichoderma reesei
gcgtggtcgcggccgaggtaccatattgtcaccgaggagggtgctcgagagattccacccaagcccgtgttgagcaaacgcggcaaagtcaagaccaagaacctccagccaacatacaagaagggtcagggtgtggaaggtcttttgaggagctggcgaattggctggtggggcttggtcggcctttggatggctgatatggttgggcacggaggtgacggcgagttctaaacgaccaggcaaagataggaggagccgaaatggcatgtataccagtgagggcaaaagggaaaaatggaaaaggggggggaaaggatggagagatattggcacacccatctcccgaggacgacaggacgaggaagaagaagaagaagaagaagaaaaatctccgcttcgacgacttttatgatggaacgataacatcatgattatacgttcatttatacgcatacacgaccggctgcgaacactatcccttctttctttgtt

SEQ ID NO: 791 - DNA, 367 bp, Trichoderma reesei
tcgagcggccgcccgggcaggtccccaacaccaccacaacccacatcaaccatcatgactggacgcggcaagggcggcaagggcctcggcaagggtggtgccaagcgtcaccgcaagattcttcgtgacaacatccagggcattaccaagcccgccatccgacgtctcgctcgtcgtggtggtgtcaagcgtatctctgccatgatctacgaggagacccgaggtgtcctcaagtccttcctcgaggtgtcatccgtgatgccgtcacatacaccgagcacgccaagcgcaagaccgtcacatcactagacgttgtctacgccctgaaacgacagggccgcaccctgtacctcgggcgcgaccacgc

SEQ ID NO: 792 - DNA, 205 bp, Trichoderma reesei
gagcggccgcccgggcaggttcgtaaatagccctttttggacttgtgactgaggagagcatacagggggagggtgtggatgtgcacagggttgattggtatctgcttggtttgtctgttgtgtttcgttatttcaccttgtggaaatgggcgccccatagcccggcatcttctggtaaaaagctttcagagtatgaccactcggc

SEQ ID NO: 793 - DNA, 494 bp, Trichoderma reesei
tcgagcggccgcccgggcaggtacatacagaatcccatcacagcttgaaattcttgatcaactgtaattccaacaagtccagatccatgtaagtgtttaaacttaacatcaatcccatacttatccttaaaaattgagaacacctttgaatacataagtgtaaacatatgtgatgtttctgaatttgtaaagatacgaacaagtggaataactcgttgagaaataggactataccagccccaaatgatctctatattgccagagacagcaacatgtttataattaacatcaattgttaatgatgttaaacatgattgcttaaacatttctgcctgagcctggaaaaagcaaatgataatatactcatccccatcatcatccataaactgaatatactgctgctctcttagagctttatcagaagtgatttactttcttcttctttcccatctaggaaacagccattcgggatgctccttgcggaaaatgaagca

SEQ ID NO: 794 - DNA, 163 bp, Trichoderma reesei
cgagcggccgcccgggcaggtactacagaggcaacgagacgggccaggtcccgggcatcctccctgagccatactactggtgggagtcgggcgccttgttcaacaccctgatcgactactgggcccagacgggcgacgacacgtacctcggccgcgaccacgc

SEQ ID NO: 795 - DNA, 153 bp, Trichoderma reesei
tcgagcggcgccgggcaggtactcgacgacccagccgcccgccgtgagcaccgagccgaggtagaagaagaagaagaggctgagcagccagacgctgggcggggaccccgccttcttgatgagctgcgtcgcctccttgttctcgatactgct

SEQ ID NO: 796 - DNA, 362 bp, Trichoderma reesei
tcgagcggccgcccgggcaggtacaagaataaggtcaccgaggaggcgctcaagattgagagggagagcaagacgggggatttcaaggaggtggcgccgtatgtgagtgggaagaggggcaaggaggtctttatcaatggtgatccggagcatggggtttggacgacgggtcaggtcatgggactgatccacgatatcccaacgtgtgcggagctggtggctcgtattgaaaaggaggccgagacggtattgcgggagaaggtgtccttgattgtgtcggacacgaagctgtgagcgtgaattgagcgggatgagtcgatatggaggttgacgattaatgcatgtcctcggccgcgacacgc

SEQ ID NO: 797 - DNA, 79 bp, Trichoderma reesei
gcgtggtcgcggccgaggtactcggccaaggtgtgcgccaaatcaacgaggaggatgagaccgagaacgaggaagagca

SEQ ID NO: 798 - DNA, 398 bp, Trichoderma reesei
gagcggccgcccgggcaggttacaagctttaattttttttttttttttttttgacttatgacaaaatttgttaattgtgctacaataggataaatcaccccgacaaggacccaaccagggggccgctcatcgtcactccccccttttttaccccatactctttccattttccacactttaaccaaaaaattggacttcttctttttctccttctccttttttttaaaaaacaaaaaaccaaggcttcaaatcctggtggaaaatcggcccgcaaggtcttcaaggttttccaccccaaggttcaccccaagaagcggttggtcaactccggccgcaaccaccttagaggggaaattccacaacatggggggccgttaataaggggatccaacttcgga

SEQ ID NO: 799 - DNA, 249 bp, Trichoderma reesei
cgagcggccgcccgggcaggtacgccatgagctgaacggtctcccgccatgcaccctgcaagagtcatcgtttccctatgctcttcctacgtttcctaccattgagagttttggacagagccgcgtggacgcacgtcacgatgcgtccacgtggcattctacgacgctctcatactattaccaccttgccgagatatccttgcggcggctgctcaaccgtacctcggccgcgaccacgctagaggcgaa

SEQ ID NO: 800 - DNA, 399 bp, Trichoderma reesei
cgagcggccgcccgggcaggtaccaccacgacggcgggtattatgatggcgatgatcagtatcacgacgaatatcagaatcatggaggctactacgaccaggctcctcgtcaaggctctgaggaagattctgagacattcagcgacttcaccatgaggtcggacatggctcgcgctgccgagatggactactatggtcgcggagacgaacgatacaacagctacggcgaccctcagtcgggcggtcggggatacagacctccctcttcccaggtctcctacggcggcaatcggtcgtcgggcgcgtcaacgccaagctacggcatggactatggcaacgtgttgcccgcgggacagcgctcacgcgagccctacccagcctggacctcggacgctcaga

SEQ ID NO: 801 - DNA, 391 bp, Trichoderma reesei
cgagcggccgcccgggcaggtacgacttcttccagatcctgtccattgtcggcggtctgctgctcctggtcaacagcggccccggccagttcagcatcgacgagaagaagaaggttactaaacccccgaaaacgaatacaattacgaacgcacttccatgtttggattcgatgacatgtgggcaccgttgccccaagatctgaagctgcgcacaaactctcatacgagttgtccaccccttcatctttcttcctcaagtcgtcatggatgactgggagtgaataagctgagaggagtcgacatggcaaagtatggcctcgctagtggttgcaattctgcaaatactgcataaagaggggaaacaaaaacttactgaatctatttactacgg

SEQ ID NO: 802 - DNA, 232 bp, Trichoderma reesei
cgagcggccgcccgggcaggtgccaactggaaatgccgccgagccgccgacctggtcaatggcccggtgcttgtcgaggacacagctctctgctttaatgctctccagggcctaccagggccttacatcaagtggttcctggacaagactggccaccaagggctcaacaacctccttgcggcatacgaggataaatcggcagaggccgtgtgtacctcggccgcgaccacgc

SEQ ID NO: 803 - DNA, 238 bp, Trichoderma reesei
tcgagcggccgcccgggcaggtcgggaatctcaaccaattgatgatctcctcgtcgcacagggaattgccctgcgtcagaccgcaagatagacaatgccaaaccgccaggccatcaagtaaatgcactcctttcggactctactcacagaccgcatccatcaactcatcaactcgggtctccccctccccccctttttcttttcgtttcacattgtacttgggccggacccacgctag

SEQ ID NO: 804 - DNA, 167 bp, Trichoderma reesei
gcgtggtcgcggccgaggtacaatcgccgcaccccgtctatcgaaatgtcttgtcattacttttcttcatactcttcgttttccttcttcgtttatttggtagcgtccttgaggtaggcaatcaggtcgttgcggtccttctccttcttcaggccgcacctgcccgg

SEQ ID NO: 805 - DNA, 402 bp, Trichoderma reesei
gcgtggtcgcggccgaggtactggatcacaatcggctgctcagcgaggggtcccaatttactctctccaggtgtcgacgacggaatggtttgcttctctatgcgcgcccatgtcaagtagacgtcaaacagcagaagcaacacccccaagcgaataatggaagggtcgaagcgatcgccatctcgcatcagggtgttgtgcagtaaatggcgatagacctgaggtttgatgaggaccagatcgataaagagaacgacaaagtcgtgctctacatatttatcgcaaaagttgccgcatttgcggcagacagtgagacgaatcaagtggccattggacttgtcatcggctccagagtattgtgtccatagagttttgacggataccggcattctatacagatag

SEQ ID NO: 806 - DNA, 213 bp, Trichoderma reesei
cgagcggccgcccgggcaggtactttgccattgtatttctctttaagactatcgtatctatcttctctgtcgcacgccaggattctaagcttgcagtgtcaattctactcgacttggtcttgattcctgggaaggcgacgtctacgtgaagtgggagccacaattgcgaggtcgttctatatctgcaaaaagagacctcggccgcgaccacgc

SEQ ID NO: 807 - DNA, 437 bp, Trichoderma reesei
gcgtggtcgcggccgaggtacctctctacctgcacattcacctcagacagacagacaagctccacaaaagccaaagcaagaccgaaacgcaaaacgagcaccaacaaaagaggcaaaaaagccaaagcaacgcaatagggaaacagaaagtcaaccaacaacacggcaaggaaaaccacatcacaactctatactcacccgattggaacagtctgacatcgaaatcagtagtcactggccatccttgaacacatcacaaaccagacccgggacacagaacacagaacacagaacccacaaagacaccatacaaaacaccggcaatccccttgttttctctgaagtttttttatagtttctttctgaagagagatgcctaaagacacgaacagaggcaagcaaagggagagaggataaaaaagacaaaaggaatgggg

SEQ ID NO: 808 - DNA, 335 bp, Trichoderma reesei
gcgtggtcgcggccgaggtattcgcaaagccaaaagtcctccatgcacaatctccttccgagctgcatgctcgaggatacacaagcagggtgactttctattcccacgaactgagcacaagagacttttttctctggttgtcttgactcaggggggaaagggaagggtaatatgtgaaggtttgtgacgaagacgcatttggcatttgtataccactatgtattacagtattgctgctatatatcctatagagtttgctcatatacatagaatcgtcgatgggagaaaaaaaaaaaaaaaaaaaaagcttgtacctgcccgggcggccgctcgaa

SEQ ID NO: 809 - DNA, 405 bp, Trichoderma reesei
gagcggccgcccgggcaggtaccagttccgagagacgctcatggacgagcccgagggcaaaaaccccgtcaacggtgtctttgtcctgctctcagagtgctattcgcccacttgcacaagagaccagctctgctactccattgcttgccctagacgactagagcaggtttctaggttaaacctgaaggttaacccaggagggctgcgcaaggaagactcggcgaatgtcaacgatgaggaggttgaccagacggacgagcaaaagctgtggatcaactccgtgcctaaggagatcgctgacgcggtgagcgagcgggagaagaagcgacaagaggtcatatccgagatatgctacacggagcgagacttcgtcaaggaccttgagtacctcggccgcgaccacgc

SEQ ID NO: 810 - DNA, 382 bp, Trichoderma reesei
gcgtggtcgcggccgaggtacaagaactccttcgatgccgcccgccagatcattgccaagaacggtgtcaagtccctgttcaacggtgccggtgccaacatcctccgtggtgttgccggtgctggtgtcctgtccatctacgaccagctccagatcctcctcttcggaaaggccttcagcggtggctctggttaaattgctttttctacgttctgcatagacattctccctgcgtggtcacgcggagatggggtttatcggccaggtgggtgtaaagcgcccgtccactggttgatcaaaaaggagaccggaatggagggtattgagggaagttgggccagatatcccgacctgtgtaacagttgctatttgcgggttagac

SEQ ID NO: 811 - DNA, 269 bp, Trichoderma reesei
tcgagcggccgccgggagggtacaagcttttttttttttttttttttttttgcgaacagttagcccaagttactgtggtggaagctgatagatgccaaaccggatatatctgtcctcctctccgaatccaggaatgctcacttgtctttcctcgttaaaccccacctccacacgccatcgagtcccggtcgttgtcccaatctcatcccacagcttctgaagactttcttggttgtgcagaaacgaccccaacttgccttccctctctc

SEQ ID NO: 812 - DNA, 250 bp, Trichoderma reesei
tcgagcggccgcccgggcaggtttctctttcgcttaaacctgtgagaggttgcggctactacttgtttgtcttttttgattttttgtaaatcatcagtttgtcctctttttttgttttttcccctttatagtggtgccttctgtgttttccctttttttttttcctgttgaagagactctgcccatcatgagcgacacagaaaaggcgccggtcgcagacaacatctccaattccgagctcgaccagatt

SEQ ID NO: 813 - DNA, 160 bp, Trichoderma reesei
gcgtggtcgcggccgaggtactgttacagcgctaggattagcagctcgaaggatcaactccatgtctccaagtttatgctgtgccgcaccttcgtcgtctctcttcaactcttcatgtccagtacaatacagcggtgagcgaatagagctgcagatgcta

SEQ ID NO: 814 - DNA, 194 bp, Trichoderma reesei
tcgagcggccgcccgggcaggtacggcgcgggctgcagagggaacagccaggcgtagacgtggtcggcgatgaaggtgtcggtgagctccagcacgacatccatgatgggcagaccaaggaagacgaaacaatacaaggtcagaatgggacaaagaagggacctggacagctggaacctcggccgcgaccacgc

SEQ ID NO: 815 - DNA, 53 bp, Trichoderma reesei
acattttgctccagatattcttggctccgtcttcttcctcatatatcttcacc

SEQ ID NO: 816 - DNA, 472 bp, Trichoderma reesei
gcgtggtcgcggccgaggtacattacatatgggcgacatatggagaaaaggggtgaagagaggaaacaggaatacataccttgcatatcacaccacagcattcactggaagcctctgcagaaaaagccgttagctctcactgatatcatcacggagaaaggggggaaataaggcgggcaaggggttcctcgtaaagaaagtgaacaaaagaaaagagtttagaggggggaatgacaaagtctgaagacaacatgaactccaaggatgattccaatacagccacccttccaaaacaaccctccctgactctctgcaaagaacgacatataaaaaaccttgactcaaccatccatgaccgacaataaattcaccctccagaagctagtctcgcgacaaccaagccgcgccttcgccgccaacaggccatgacgacgcttttgctatattgcagcggctataattacatatccat

SEQ ID NO: 817 - DNA, 117 bp, Trichoderma reesei
cgagcggccgcccgggcaggtcttctccctcgcagcatacctgatccgtcttcttcttttcttttttgggatgcaactggtgctgtgtaggatcggaagacctctccgccgttgcta

SEQ ID NO: 818 - DNA, 49 bp, Trichoderma reesei
gcgtggtcgcggccgaggtaccgacgccgctcaaggcccgcggacgcgc

SEQ ID NO: 819 - DNA, 167 bp, Trichoderma reesei
gcgtggtcgcggccgaggtaccgctgggcgacccagagaagcccaaaggtgatgacggctaagatggaaatcagcggcgcaacaacgctatagatgatggcaatgcaggcaaagttggtgtagacgggggaaaaggtgccttagaacatgtcgctcaggttcgtgtt

SEQ ID NO: 820 - DNA, 304 bp, Trichoderma reesei
gcggggtcggggccgaggtactctctcaacgccaacgacgagatccacgccctcgtcttctctcccaaccgatactggctctggctgccaccgccagcagcatcatcatcttcgatctcgagaagaagagcaaggttgatgagctcaagcccgagttcacctccgttggcaagaagagccgggagcccgagcgtgtcagcttggcctggtccgccgatggcaggaccctgttcgccggctacactgacaacattatccgcgcctggggtgtcatgtcccgagcataagcttgttgcatgttagg

SEQ ID NO: 821 - DNA, 158 bp, Trichoderma reesei
gcgtggtcgcggccgaggtaccagtttcgttatcactaaaaagggattgatgcaagccgaagagcgacacggattcgaaggcgatggattcgtatacctcagaagcccttatggtgggcgggtatgcaactcttggcatcggagagatctgcaacttt

SEQ ID NO: 822 - DNA, 99 bp, Trichoderma reesei
gcgtggtcggggccgaggtacgcagcctctgtctcgtcacgatccacctcgagcgagggacaggaagactcgaccaccaggctcgcaaaggatgcctcc

SEQ ID NO: 823 - DNA, 283 bp, Trichoderma reesei
gcgtggtcgcggccgaggtaccagatctccaagagatatggcggcgaaggcctcccgcttgacaccgttcatgtcaatatcaagggctctgccggtcagtcctttggtgcgttcctcgcgcccggtgtcactcttgagctggagggtgactccaacgactatgtcggcaagggcttgtctggtggtcgtctgattgtctaccctccccgttccgccgtgttcaaggctgaagagaacatcctgatcggcaacgtctgcttgtacctgcccgggcggccgctcg

SEQ ID NO: 824 - DNA, 285 bp, Trichoderma reesei
gcgtggtcgcggccgaggtacttcaaaatgcagctcgtgtctaagccgccagagtaagcgaggcacaccttttgtttggccatgttcgttcaagggcggtatggctcgctgatgtgaatgttgatgatggaggcgtgtgtgaggatgtgcagagtcccaagaaacggctacgagtgaggggaacgagggtgcacggttgcttgggccattcttgcacgaatgaattggaaactagttggggtcttgttatcctcatgacgtatcgctcgctgttaacattgtctg

SEQ ID NO: 825 - DNA, 51 bp, Trichoderma reesei
gcgtggtcgcggccgaggtggcgcctgagagacggaatggcatcatctagg

SEQ ID NO: 826 - DNA, 55 bp, Trichoderma reesei
gcgtggtcgcggccgaggtactgctccctcagcttcatcgtgcctttcgtgcgac

SEQ ID NO: 827 - DNA, 201 bp, Trichoderma reesei
cgagcggccgcccgggcaggtacaagctttttttttttttttttttttttggaatagaccagtcacgaattgttcaaagcatttatcattccgtctactcctagtgttgtgcaatgctagacacctcttttgctcagagaaagggtatgatcatcactgcccatcctctccacgtcccccaattcctgtcgccgactcact

SEQ ID NO: 828 - DNA, 72 bp, Trichoderma reesei
gcgtggtcgcggccgaggtacgacaatagaacaggcagctagccatagactttgaagaagcaatccaaaggc

SEQ ID NO: 829 - DNA, 161 bp, Trichoderma reesei
gcgtggtcgcggccgaggtactgcacaaaacataacaggtcgagccgctcactcgtagtcgctcatgagtccgaagatggacgagccagggtgcgaatcaccgcagcatgggacagatgcgatcgtcgtcactatcccaaaccgattcctcaacctcatag

SEQ ID NO: 830 - DNA, 335 bp, Trichoderma reesei
ggagcggccgcccgggcaggtacatgcgtgatcgtatcgcccgctatatcatcctgaatgctttcttttcccatccctatgtatatctcatgctccatctttatgtatcatatatttcattccaccccccgcgatctagaattgcggcaatactcctcatcgacgagctctagcaggcagactcgcctcagagcgacctcgaaatgagcaaaacgcagctctagaaagaaaccccccatgctcattgtgttgtctgaggtggtccgtctgttgttgagttgttgtcggatgtgctcacctgtgcctgcggctccgcggcggaagaagacgtaacc

SEQ ID NO: 831 - DNA, 322 bp, Trichoderma reesei
cgagcggccgcccgggcaggtactcaaagatagtagactggaatgacagcatctcatttctggctgattctggaaatgacaacgagtgtaagtggagggtgtgcgtgcgtgcgtgcgtgtgtgtgtgtgtgtgtatgtcagaccacgagctgtcgttgcatttctgcttgcgctggacccttgagccttcccacccctttcgtctggtcaacgataagctggcatgactaattgttggtcgaatgagggagacattcagggttgtcttttttttcttgcgaaatctatttccgttgcgtcggtacctcggccgcgaccacgc

SEQ ID NO: 832 - DNA, 364 bp, Trichoderma reesei
gagcggccgcccgggcaggtggggaaacacgcctgaccagattattcgagaaagcaaagaaaaacagagagaatctacgcatacacaggatctactaattaatatgtgcttgtctcaccgaccggacaaacacgcggcggcgttaggttctgtcttttctcttctaatggatgttaaattgtttaatcttgtctttgttgtttcttggaagatgtgaggtgaagtaatggcagtggttgtgtgaagtggtgaaaaagaactagcagtcgaattgtatggttagtccaataattcaaaactattatcgaaacaaaaaaaaaaaaaaaaaaaaaaaaagcttgtacctcggccgcgaccacgctaa

SEQ ID NO: 833 - DNA, 313 bp, Trichoderma reesei
gcgtggtcgcggccgaggtaccgccacccaaaagtcggcctctagtattgccctgcagaagcgaaagcaagaggaggagaaggaatacagcctgtggactctcatcaaggtcattgcctctttcaacgccccgagtggaagtcatgcttatcggcctcgtcttctctgccatttgcggtgcggtaacccgacctctgcagtcttttcgccaagcagatgttactctctcgcagcccatcactcccgagaacaggcaccatgtcaagaagacttccgacttctggagcgccatgtacctgcccggcgccgctcg

SEQ ID NO: 834 - DNA, 422 bp, Trichoderma reesei
tcgagcggccgcccgggcaggtacttgacaacagttgcgtgtcctcctcgggaagctaatgataaaatgttctcgtcgccagttacccaggcttttggatgtattccattggcaaggaggaaagaagaaaatagtgcttcgtcttccttgacgagataagagagcacgccttttcgtcgcgagaagacaaagctgctcgagagcctggtccgtctacttctatcctggcaatattcttcccagagattatgaaagggcgagtctgagggcatcgtctccgctcgctttcttagaaaagcccagacagcttcgcggctgcctgtagcaagcgccgcaaaaatcggtgtgccataacgctcatcctcaagttcgatatcaaaacatgaagttgcctgaggatgaatgcggagaaggtgagcgaa

SEQ ID NO: 835 - DNA, 453 bp, Trichoderma reesei
tcgagcggccgcccgggcaggtactactgcccagaggtctttctggacgcagcagccacgaagctggcttccacggctgttctcttcctcaatgtggagctgctttccgagttctactgcaacttcccgcgggagctggatctccgccttggacgacgcctgtctccggaggaggtcgagaagtttgccaaggaagaccccaagattcggcgacacctggaggtcatccggaagaaggagctcctggagttggtgctcgagaagatggacagcctcagacaactggaaggaagggatagggagcatggatcccatgcgagaagaggggggcctaacaaggaccgtggacgatggggactcttttaagcccaactcaaccatcgcatatgccccggactgctattgcgagatgacgctgcgttggccactggtgtacctcggccgcgaccacgc

SEQ ID NO: 836 - DNA, 73 bp, Trichoderma reesei
aaataaaaacacaacctttattctacacctgttctcaattagtcaatattctctcctcgcacattcacaatga

SEQ ID NO: 837 - DNA, 371 bp, Trichoderma reesei
tcgagcggccgcccgggcaggtaagaaccacagacaactacaaacaagatggttggcgttgacgcagagattatcgccgatgataccagaatcctgggtcaggatcctttgatccccccggctctgctcatctccgagatccccatgactcccaatgccctccagaccgtcgtcaagggccggagagacgctgcccagatcatcatgggccagaacgacaggctattagtcgtcgtcggtccctgatccatccacgaccccgaagccgcccacgagtacgccgcccgcctcaagcagctctccgagaagctcgccgacgacctctgcatcgtgatgcgcgcctacctggagaagcctcgcacgaccgtcgg

SEQ ID NO: 838 - DNA, 58 bp, Trichoderma reesei
gcggccgcccgggcaggtgaagggcggctgagcgggatgacgatgatgtaacgctgcg

SEQ ID NO: 839 - DNA, 372 bp, Trichoderma reesei
tcgagcggccgcccgggcaggtacttttttttcgtgctttattacgaccacagcaaatgggataaaggatatacctatcgcttcttttcttcgagtcaatcaaacactcccaacccagatctctcgtctttcccttcccggagccggactgtccggggccgccaaagcaaccatgaaccgggttcctttttttttttcgacaactcaattataccaaacggactggcttcggcgggaaaggaaagggatttggcgcggcaaacttattttggggcatttttgctttgcttcttttctcgcgaccttcttctctttacctttctttcttattttttttgccttctcgacttctgcataaagtgcgaacatcta

SEQ ID NO: 840 - DNA, 490 bp, Trichoderma reesei
gcgtggtcgcggccgaggtaccctttaaacctaattaagatgaataacactagtctccctacgtattaacgcggactgcttagcaccgaatttagtcaagagaagcatatatataccctcccctaccccgtattttggcccacgccggaatcccactccccagcaccgcccccgaagggttcaaaacccccaagtattggaacccggataagggccctgggtacgttctccccccggttggcccgggtcaaaccgcttaacccccgtggacccaaaaattttcccccacgggtggtaacctggccccgggaggggccccctttccaaaaaggccaaaatttcccgccccccctgggggggccccgtttatataaggggaaccgcaaacttccggtaccaaactttgggatgcaaaaaccttggggggttctccttataggggctccccccaaaataagcttggggcggaaatacaatgggggcaaaaacc

SEQ ID NO: 841 - DNA, 175 bp, Trichoderma reesei
gcggccgcccgggcaggtactcgggcggcgcggacacctttgtcaagcgcctagaaatgaccttccagcccggcgtctactcgggcaacggcgcctttggcaacacaatcttcaacccgggcaacgaacccagcttcacgaccccttacctgtacctcggccgcgaccacgctaa

SEQ ID NO: 842 - DNA, 285 bp, Trichoderma reesei
tcaggcggccgccgggcaggtccaggatgcggtctagtcttcccaagtattacacgtcacgcatgtggcgtgtcttgctcattcacttgttaagtctcttcttcgatgcagtctggctcatcgacgggtatattgtgcgtgattctatatccctgccgcctagaacgacgactacagctcgatgagcgattcgctgactacgctcacgatatacaaacgacgagctactacactatcggatgacgaacctcgagccggcggcacacgcctatggtgctgtttccg

SEQ ID NO: 843 - DNA, 252 bp, Trichoderma reesei
cgagcggccgcccgggcaggtccaggatgcggccaagtcgcccaagtggacggttcacggggtgtttgtcttgctcattcacttgggcattctcttcttcaatgcagtcaggttcatggcgggtatattggcggattctatatccctgccgcctagaacggcgcttcatctcgatgaggaagccgcagactacgttcacgacgacaaacgacgactactaactacggatacgaacctcggccgcgaccacgc

SEQ ID NO: 844 - DNA, 276 bp, Trichoderma reesei
gcgtggtcgcggccgaggtacgcaacctcttatgagcggccatgttgaacgtgtttggcttattctgccacccgcggttgagctccagcctcatcttgacgcagcggaaaatcatctcctctccccccttgaagtcaatgccgagctggacaatgtcgccatcattgacgggaaaggccttgctctcctgcgagggcgggctcaatcgtatgtggttgaggaatgtgccggacgagctcttgacgtccttgatgtacctgcccgggcggccgctcg

SEQ ID NO: 845 - DNA, 117 bp, Trichoderma reesei
gcgtggtcgcggccgaggtacttgccttacctttcctgctaatactatcggcatacagttccgttccttgtcgacctgggaggaacacgcacgcacgcaccaccaccccccccaaaa

SEQ ID NO: 846 - DNA, 396 bp, Trichoderma reesei
gcgtggtcgcggccgaggtattgtgcgttatgctgcatcgccggatgtgcgactgaagccgaagcaaaacagcagatcttcgatccatttagcttccgagtcctcccccttgttctatttcttatttcttcttctcctcttcctttttcttttcttcttcttcgtttccttctccttcttcttcttcttcctctgcatctcttcaatagtccaatgcgttctcccgcttccgagccgctctactacagcctcgacagctggtgctatacccttccgcgaacctgaactgaacccgacggcttgattggatcgtgcctctcagctttgcttctgttttacccgtcctctcctgcttgctactgctgctgtacctgcccgggcggccgcccgggcagg

SEQ ID NO: 847 - DNA, 207 bp, Trichoderma reesei
gagcggccgcccgggcaggtacctaccacggtcggaacgggccatgtcgggtgtggttcggggaagaaatctcggagtgcatctcgaggcactaccagagtgatggcgacctcgggcgggacatgtttccatcgacttaggagaccagtattgggcaccttcaatacacccgtcaccccaatagaggtacctcggccgcgaccacgc

SEQ ID NO: 848 - DNA, 392 bp, Trichoderma reesei
gcgtggtcgcggccgaggtacaagtttcaagccggcaacttgagaatttgaggcaggcgttggaggctgtacgtcgtgttgtgcaacaatacacctcccggcgcatcacacagagctgtttcatctctgctaaacactaactcatagatccagcgaggaaaagaaaaatctcggcatacctgattgcttttcccccttcattacgtccgcacaatattctcactccccaaaacagcataccaaaagacattcttctgcgccttggcctcaacatcccgcttctgctcctccgaaagctgcggcccctgcaagtcgttgaggaagcgcccgacaaagctgcccacaaacggcttcgcatacaggtcgtacctgcccgggcggccgctcgaaaa

SEQ ID NO: 849 - DNA, 184 bp, Trichoderma reesei
gagcggccgcccgggcaggtgtgagcagcgcccaagtctccgaaaaaaggaagaagagagtgcaatcagtgcctcgaggctcgcaacgcaacaaaccaccacgtggaaaagtcgcacgaaagacctagaaggcgctacgggtttggtcgttcagcagagtcaaacatacaaggcttacgactgc

SEQ ID NO: 850 - DNA, 421 bp, Trichoderma reesei
tcgagcggccgcccgggcaggtacactttgttgcctcctcctccattataatcttacatccaaatgaatgaatttcctcctgtcagttggttcccatgcaatccatttcagtccatcatcacacatcatgcttttttgtccgataacctcacttggtcagccccggacagagcagacactcctcccgctcagtcatgtcgaaagccgcccatctccgtcttattcctgccgctcatctcgccgagcgtcttgtcgcgctgctgccgcgcctcgtcggggttcttgtagatccagttgtagccaacgagcacggccaatgcggcgccgccaatgaccagccagttgcggcggagagcttcaggaccgcccggtttcggcgggatcggctgctggcctcccgggccgcgagtctcttgcactc

SEQ ID NO: 851 - DNA, 316 bp, Trichoderma reesei
gcgtggtcgcggccgaggtacggatggagagaggagtatatgccgatcagggtagaatacgcaaggatcttgtgtagcgcctgtagcaagcctgaaacgtcctccccacgatcaaggaagccgaacggttttgagaaggtgatattgccgatgacgtcgaacgcataacattggaaccagtggcccatgttgataggctctctgctctttgagaacaaggacaagcgattctgcaggacgtccgcgcactcatccacgtatctctcgtagctgagaagactggacttactgtacctgcccgggcggccgcctcgga

SEQ ID NO: 852 - DNA, 198 bp, Trichoderma reesei
gcgtggtcgcggccgaggtacactacaaggcaagctgtctagctctaccaaagctagtatcatgggagaaagaatagctagagaacagtctttccgtcactaccagtgcaagtagtccatcgctttacgcattctgcttgtccgtcttcatattgcttgatgatagaggagcaagcactcggcttcatggatgcggca

SEQ ID NO: 853 - DNA, 434 bp, Trichoderma reesei
gcgtggtcgcggccgaggtaccattgttgttgttgttgttgttgttgttgttgttgttgttgtcaagaagggcccgagccgccgctccaccatgatccgatctcacgcctttagattcatgaatgtcctggatgcatcctgatgtaggggttgtatcagataccaggaatggatcaccatgctccgtatattgaaatacgccttccggatccaaactgctggcttcttcaatagctgcatgttgcgcgaggctgttcaaagtggaacaggctccctcgtagccggtgtcagtggaaaggtcatagtcacccgcgattgcaacgataagagtatcatctagtgaagagcggaatgaatccaggagttgttggagttgtgaagatccagtggtatagctcattgggggaccagacaagacatgagacctgcccggg

SEQ ID NO: 854 - DNA, 65 bp, Trichoderma reesei
gcgtggtcgcggccgaggtactattattacctttcgttgcaaataaaaagaacaaaagacgagcc

SEQ ID NO: 855 - DNA, 84 bp, Trichoderma reesei
gcgcggcgcgcgcgaggtactactagtggatactattgcgctatatcccccgatctattcctcgccctcgggtagaaacgatgc

SEQ ID NO: 856 - DNA, 415 bp, Trichoderma reesei
gcgtggtcgcggccgaggtacaagggctgggagaaggagaccaaggctggcaagttcaccggcaagaccctccttgaggccatcgactccatcgagccccccaagcgtcccacggacaagcccctgcgtcttcccctccaggacgtctacaagatcggtggtatcggaacagttcccgtcggccgtatcgagactggtgtcctcaagcccggtatggtcgttaccttcgctccctccaacgtcaccactgaagtcaagtccgtcgagatgcaccacgagcagctcgctgagggccagcctggtgacaacgttggtttcaacgtgaagaacgtttccgtcaaggaatccgccgtggcaacgttgccggtgactccaagaacgaccccccatgcgcgctcttcacgccagtcatcgt

SEQ ID NO: 857 - DNA, 333 bp, Trichoderma reesei
gcgtggtcgcggccgaggtcttaatcaatacggacattgcccgctgcgcggacgaccgctgagaatcttttctttctttaatacccaagcctaaccttgcaagatggttctgcacaaccccaacaactggcactgggtgaacaaggatgcgtctgcttggacgaaagactggtttggcgagaacctgaccaagctcgaggtggaagatggagatgtcaaggctaggatcaccaaggtccagagcatgaccggcgacgtggatgtcagccagcgcaagggaaaggtcatcaccatcttcgacgttaagcttgtacctgcccgggcggccgctcg

SEQ ID NO: 858 - DNA, 425 bp, Trichoderma reesei
tgagcggccgcccgggcaggtcccggataaagaacgagctctggatcatgggatgggagatatcgagacgcaaaactacgaacaaacatgtaaaaaaaagaaacagggcgaaatcgtttgtttaatcgcaaaaaagcttccaacttattcttctctaaatctgttggagggaatacacggggtgtttggttcaaggcagttcagtgatttccaggctcggacggacggaacgggtgcaaagaagggcgtgttgaagcgtgttggaagtgttagatcgggtaggaaatcagggggaaaagaaaagaagaaaaacaaaagaagccggctgtattgatgggtgggtggtctggagaagctgttaaaaaaggcaaggaggctttttccccttggcagcttcatcccttgtacctcggccgcgaccacgc

SEQ ID NO: 859 - DNA, 179 bp, Trichoderma reesei
gcgtggtcgcggccgaggtacttgcggacgacggctttaggacacatcctattccctggctgactctctggggaatcagacttacagtcggctgggcagtcttgactccacgccgtcgaacatttcactggatggccaaggttctcaacagcctcgcccaggagtggcgatatgccccc

SEQ ID NO: 860 - DNA, 366 bp, Trichoderma reesei
gcgtggtcgcggccgaggtggcacaatggatgcgtttgttatgctgctactcttatacgtccagaacataacccatctgagaatcactggggttttcgctcgagcaaatcacctacttggcatgatgctgagggctgccctttgtcaagatttgcattgcaggctcccgtgcagttgcagttcctacagaatgtggttaccgaacctgagttgagctgctcccgatacaatgatcctaagaatacggccgatattcttccaatgttctatcttccttccgtccggtcaatcgcagctgaaatcgacaaccctgccatatttgcgtggcaacgtatacgcccaatgccctccatatcacgacgctag

SEQ ID NO: 861 - DNA, 140 bp, Trichoderma reesei
gcgtggtcgcggccgaggtacaagcttttttttttttttttttttttttttttttaatttttttttttttttttatgcaaaagttcttcgacgccatcggaaaaggcccagccactccaacgtcaccaaagtcgtcaagg

SEQ ID NO: 862 - DNA, 358 bp, Trichoderma reesei
cgagcggccgcccgggcaggtggacagctttcgtggattctaataagaataacacagcaattgcttggttgagacgcaagaggttcaggtcgtcaagatgtctgcgctcttcaacttcaagtccctcctgctcgtcatcctgctattaatctgcacgagcacatacgtgcaccactttacgcccggcatcatggaccggaacaagaacggcgtcatgggcatcttctggaagtgcgcgaggataggggaacgactgagtccctacataagcatctgctgtgtcatcatggctgtctccatgctgcttagctaagttgcctacacactcaagcgtagcgtacctcggccgcgaccacgc

SEQ ID NO: 863 - DNA, 269 bp, Trichoderma reesei
gcgtggtcgggccgaggtacatctgttgctcaagaactgaatatttcgactcaaagccagtggtgtatgctaaggtaggtcaaaatcaaggaatggtgggagagggaagagggtaaagagaaaaaaaaacttggaaatgaagagggtgattctctgcccccccgtgaactctgacacacaaaaagaccccaagaaaagataaacacccaggcaggccaactttgtccttgccagtaaccgaacaagccatgatattgttggaaattgca

SEQ ID NO: 864 - DNA, 453 bp, Trichoderma reesei
gcgtggtcgcggccgaggtctcgagatcatcttccggtatcaacaaactactttccactctgcgacggcccctaaattcgcccagcagtcgatcgaattccccaacgcccaagactggcgaaataacgagcctcaatgcatatctggagaatatatcataccacagcggctggaagctgccctgaggaggaattggaacacacaatatgcggtcgagatgcggtcaaacgagtatcggattcgggcgccaggaaagctcagtgaagacgaaatccgcacattttactccccgggctactactagacagccctaccataccttccacctgtatataccaaatccgaatctccatccatgttacgggaggagatatatcaggtattccattcatgtccatgttgcgagcaatggcgcagactgcctccatccttgacctgccgggcggccgctcg

SEQ ID NO: 865 - DNA, 119 bp, Trichoderma reesei
gccgcccgggcaggtaccgcgacaccaggccgccgagggagtagcccacgacgctcagcttcttgatcttgccgccgttgttctcaatcatccgcagctcctcaatgatctcggcgcag

SEQ ID NO: 866 - DNA, 262 bp, Trichoderma reesei
gcgtggtcgcggccgaggtaccccttcggacggtcatgaatccactcgaggcagccgagagcgacactcgatgataagtcgccgtagcattgaagccagggccaagcggcgtaacttcaggcctcttctcttcaacgatgacgtctgttgataacagcgagcccaaggctcaacgtcaagaggatgactgtcgctcaaggtggttgcctccgggggtgtgcgctggcgagcacgttgaagaatggtatcagtgcctttgatt

SEQ ID NO: 867 - DNA, 318 bp, Trichoderma reesei
gcgtggtcgcggccgaggtcgccccccagcaccggaattctcgactgcaaatagcccaagatgtctgacggcgaaatcgagatcgaaaactctgtcgttaccgacgccctccccaaggatgttgtcaaggaggtcggcaacgtcaagctgttcaacaagtgggactacgatgtcgaggtccgcgacatctccctgaccgactacatttccctgcgaaaccccgtctacgtcacccactctgctggccgatatgccgtcaagcgattccgcaagccaactgcccccatcattgagcggttgaccaactcgctcatgatg

SEQ ID NO: 868 - DNA, 248 bp, Trichoderma reesei
gcgtggtcgcggccgaggtacaagcctccggccagcttcaaagcctcagcaggaagctcggaatatgatcatatctatttcatcgagaccttggctcgccttagcaactctttccgaaatcttggccggccctgatgacgagatgactcgaccagagcttatatactttgagaccgtcagcctcctctgcacactgatgtctctgtgtgtcgagttggaccggtcttccgatatcatcgatgtcttga

SEQ ID NO: 869 - DNA, 178 bp, Trichoderma reesei
gcgtggtcgcggccgaggtacgacattgtttgttgcgtttgttgttgttgttgttgttgttgttgttgttgttgttgatgatgatgatgatggcggaaagttgtgctctttgcgggtggctcggagatggagaatgtggttgcgggttttaattcggtattggttcgtgttttggagt

SEQ ID NO: 870 - DNA, 419 bp, Trichoderma reesei
gcgtggtcgcggccgaggtacctcgacaccgtctatgtctccggctggcaatcttcttcaactgcctcggcatctgatgagcccggccccgatctggcagattatccctacactactgggcccaacaaagtcggccatctcttcacagcccagctcttccatgatcgaaagcagcgccaggagcgtttgagcgtgcccaagtcccagcgatccaaggtggccaacattgactacctccgacccatcattgccgatgctgatactggccatggcggcctgactgctgtcatgaagctcaccaagctgtttgttgagaagggtgctgctggtattcatattgaagatcaggcgcccggcacaaagaagtgcgcgtagtgttgaaggttcttgtcccatcagcgagcacatcaatcgtctgg

SEQ ID NO: 871 - DNA, 176 bp, Trichoderma reesei
gcgtggtcgcggccgaggtacgccaagaagacggttcgaattaatttgaattgcttaatctaagaatcaaattcaataataatacatcgcttgcccaattccattgcttgttcattctggacaaaatcgccacaagcgcatcctgcttcgaacaggtcggtcggcgcatcgtatcg

SEQ ID NO: 872 - DNA, 87 bp, Trichoderma reesei
gcgtggtcgcgggccgaggtacacattatctttagtttggtccctagcatcggaagcttttgctaattacctatagcctcctccgtg

SEQ ID NO: 873 - DNA, 272 bp, Trichoderma reesei
cgagcggccgcccgggcaggtacaagcttttttttttttttttttttttttttcgaaaaaacggcaagtcgtcaattccttgacctggatattctatgccaacctataccggccgccaagccatccacgagcgatcaatcctccaatgccaccagagccatccgagaccaaccgcccaacaagctcgcaacttttccgaaaatcgtagagggtcgtaactttgcgcatcctttttacaaatggagcgcttagtcgaagagaccgaagcccat

SEQ ID NO: 874 - DNA, 362 bp, Trichoderma reesei
cgagcggccgcccgggcaggtacagaaaaatcaaagagacagaaatatttggtatctcaaacctcgttcattctccctagacgttcatcaagcgcagtgcatcttcatgtccgtggtatgctctccacctccgcaattaccatacctatccaacgccaaacatgcaagaatagagtgcatcaaagactcggggtcagaagtgggggaaaaaaagtgagacagaaaagacaaagacaaagaagcaaagacacaactaaactggatgacttggtgagctctcgctcggtggcacggccttgcgtaggcaccagccgaaaacctattccaaggctgctcggagaccacggtccttgatgggcgcg

SEQ ID NO: 875 - DNA, 65 bp, Trichoderma reesei
gcgtggtcgcggccgaggtacatcgagcagggctggcccctcgagcgcatcatggcgtatctgca

SEQ ID NO: 876 - DNA, 247 bp, Trichoderma reesei
gcgtggtcgcggccgaggtacagcccaatagcaaagcatgctctctctctctctctctctcccctttctgtgtctttcaaaagacgcatccatttcaaatttgtcaagtctttgcttgcttttaagggtagccctccttgccccacttgttgaacttctcgtgagcctccttgggggcggtgacgttggggatgatgacgacgttgagggcgctgggggcgtcgcgacctgcccgggcggccgctcg

SEQ ID NO: 877 - DNA, 326 bp, Trichoderma reesei
tcgagcggccggcccgggcaggtacatccgacgattcgttaacgtcaccctgaccggtggcaagcggaagatgaaccccaaccccggctcataagcgatctcgatgacggctagggagaggaggattaagggttgacaacggggccgttctccgatggttgcttatttcagcagagggaaatggaatgagtcggtcgattgggcaggctgagcatcatcctgaatttgagagatcggaaggagcgcgacgactctgctcggcgtctggtgtcggtttgtcaatataacgaaaaattcgtccgcgagtacctcgcccgcgaccacgc

SEQ ID NO: 878 - DNA, 374 bp, Trichoderma reesei
gagcggccgcccgggcaggtacagcacagcagcagaggtagaagtggaagcttcaaccaaagaagtcgcgtctctgccaacgttggagctggaagccgacacattgggcttgctcgaagtcgaggtcttggatgttggcttgacagaagtggtagcagccttggacgtggtggaagccttggacgtggtgaaagccttggacgtagtggaagccttggacgttgtggaagctttggacgtggtggaagccttggacgttgtggaagccttggacgttgtggaagccttggtggagctgcttgcctttgaggtcgagaaggccttcgaggtcgtgctcaccttagaagcgtagacgctttcgaggtagtagaagc

SEQ ID NO: 879 - DNA, 479 bp, Trichoderma reesei
gcgtggtcgcggccgaggtacggctttgtggttgaacgatggcttgctcttcggtttggacgtggatacaatggatatatccggggatactgtctgtgatctcagcacatcttcttcgctaacatcatccctcttaacagagaggggcggcattttctcctgaacgcaaactcttggcccttggagtcttttcccccgtcgtagacccacttgagacgtggcgagtctccagagtctccagagcacgtctccagaaaaccgcccgccctctgcagcagccaagttccaacctgcggacctgtctgttggatgacggcacgagccacttgggtagtggtggagagcgggggctggtggttgttttgagctgtctgtcgtccggaatccagagcatgatctgtgacagcggcgtggattggaggcaaggcaaaccctagcgagcagatgattctcctggcattagctgcagggaggcttta

SEQ ID NO: 880 - DNA, 307 bp, Trichoderma reesei
gcgtggtcgcggccgaggtacatgttccctggagcagaggagagggttctggctggcagcacacgtcgcgaggatcaaatcaagggcttgattgcaagcagtggcaagatgatgttgattgaccagcttctgtccaagctgaaaaaggacggacaccgagtcttgatcttcagccagatggtcaagatgctggacattcttggcgactacctctccctcaggggctacaagttccagagactcgacggcaccatcgccgccggcccgcgacgcatggccatcaaccatttcaatgccgaggacagcg

SEQ ID NO: 881 - DNA, 338 bp, Trichoderma reesei
gcgtggtcgcggccgaggtctgctcatgaggacaagtcttctgaagaggagaagcttcacgaagaagttcaccactcggaggagacaaagcccgctgaggagcagcactccgaggagcagcactctgaagtggcgcctgccgaggaagagaagcctgttgagcacgaacagcactccgaagaaaagccttccgaggagaaggtcgaggctgaagacaacaacgccgaacccgagaccaaggaagagcgggttgccgagcctgccgcagagaccgccccttgaagagacctctcatgtcgttgaagagcatgctgcttgaagctgcccctgaagagcct

SEQ ID NO: 882 - DNA, 252 bp, Trichoderma reesei
gggtggtccccgcccaggtactttgacggaatcttgcttttgggtttattttcggtgacgacccgcggatacgaagcccacgatgagttgacgcaaaagattgatgaagaggtttagttatgagaggcctggttaagacgatggatgctgattcaaaactaggtatgaggcttatagaattgcaatccgcccctagagagacgagccatttctcctcggtgagcgttttgtacctgcccggcgcccgctcga

SEQ ID NO: 883 - DNA, 106 bp, Trichoderma reesei
gcgtggtcgcggccgaggtccaagattgacaaggcttgggccgaagccgataggaaagctaccaagctcaagaaggaggccgaggcatacgccaaggacgccaaaa

SEQ ID NO: 884 - DNA, 169 bp, Trichoderma reesei
gcgtggtcgcggccgaggtggcggggggggtgagggcgtctttcaacaaagacaaaagtctgggattatttgcatagacagcaacagggtcacgtctgcaaaggaaacggttacatgcacacacttatgagctacgctaatgatgggtacctgcccgggcggccgctcg

SEQ ID NO: 885 - DNA, 325 bp, Trichoderma reesei
tgggcctctagatgatgctcgagcgccgcagtgtgatggatatctgcagaattcgccttagcgtggtcgcggccgaggtcgcagctctcctccataggcgctctagagtcaagcgattcgcagctcgattcctccgcctgcgctacatgaccaatttagtctcttccaaatctaccccgacacgacgcctcgagcatgaccagcaagacacaagctctcatacatgatggcgataaaatttcaattctctctgtaatatttcacaattccgatagattgacgggcattgacgcacaccattgcatacccatacaccgtctaggcc

SEQ ID NO: 886 - DNA, 65 bp, Trichoderma reesei
ggagcggccgccccgcgcagggtggcgttctgctgaacttggcactggttgggtggcaccattgg

SEQ ID NO: 887 - DNA, 256 bp, Trichoderma reesei
tcgagcggccgcccgggagtcatctctctttggcgcatgatcttcatgggctcaactactggaagcgcaaatcgtatcccacaaaactcctcttcctcgggctcttcaccctcacagaggcctactccatctccgtcatcgtctccttctacagacctcatcgtcctcaacgcaccgtcttcacgccggatcttcgctttctcaccctcttcgcctgccagacaagtacctcgggcgacctcgccgcgaccacgtt

SEQ ID NO: 888 - DNA, 268 bp, Trichoderma reesei
tttcgagcggccgccgggcaggtacagcagtgagggatttttggcaatggcctacggctgaactggcaacttggagagtgcaagcctattttgatcatatctttgatatgatctataggatgtattaaattgataaagctttgttatatattgatatgacagtatatatatcgtgtctggactattgcgtgccagcagtcgcggtaatacgtagagactagtgtattcatcttaataggttaagggacctcggccgcgaccacgctaa

SEQ ID NO: 889 - DNA, 317 bp, Trichoderma reesei
gcgtggtcgcggccgaggtctttgtccattgctggatgataaggccacaggctttgacgagaacaagaagatccttgggtgttggtgctcgcgcggcccggcacgcttgaacaacgaatgtcaacacggacacttcgcgctggcagacagggtactgccggcgccgctaggcgattcagcacactgcggcctactagtgatcgagtcgcacacagctgatcatagctgagatctataggtgaactaataagctggcgtaatcatggcatagctgttcctgtgtgaattgtatcgctcacattcacacacatacgagc

SEQ ID NO: 890 - DNA, 73 bp, Trichoderma reesei
gcgtggtcgcggccgaggtactcattccgattacaagaccaaaagagcctgtatcagtatttatttgtcacta

SEQ ID NO: 891 - DNA, 139 bp, Trichoderma reesei
ctcgagggccgcagtgtgatggatatctgcagaattcgcctttcgagcgggccgccggcaggtacagggccttgatgtcctcgggatgtgggaatgtctggatggagcgttctcggaatgatgcggtcttcatggcgtc

SEQ ID NO: 892 - DNA, 59 bp, Trichoderma reesei
tcgagcggccgcccgggcaggtacaaatcatacttctccgctcagcattcatctcgctg

SEQ ID NO: 893 - DNA, 322 bp, Trichoderma reesei
gcgtggtcgcggccgaggtacccggtcgcgcccacaaagaccaagtatgtagtccttgtttcctttcctgctgcaggtcttccagaccggaaaccttccccttaagccggggttttcttactcgaaaacctcgagaacctagacgccagttccccttttcccagttcaagccatagtcttcataaaatcttccaagtcaaagctctcctcatactgcttgttatcccacagctcgcccaggtcgtccagccatgccttcttgctcggctgccgcagtacctgcccgggcggccgctcgaaagggcgaattccagcacactgg

SEQ ID NO: 894 - DNA, 343 bp, Trichoderma reesei
ttttacttcggcgcaatattcttattgatctttaccatgcttcctcatgttagtgactcggctcctctgcgctcccagagtaagaaaagaacagactgcccactttctgaatccgcaacctacgacatcctcatatatgggtccactccagcagccctcgctgcggccatccaaacgacgcgcatgaacaaaagtgttgcgattgtatccccaaccaatcacattggcggcatgacggtatccggccttggctggacggactccaagaatggaaatgctatcggggcatcgaaaaagagttctatggtcgggtgtatcagtacctgcccgggggcccgttcga

SEQ ID NO: 895 - DNA, 205 bp, Trichoderma reesei
tcgagcggccgcccgggcaggtacaagctttttttttttttttttttttttccaatagtcaaagccttttttattcgtggcatacccagccatcgcacccaactggttggctggtcaaggcatgtcaaatcatcccgctccatccgaggccatgtcgaaagccgtgccccaaggcgccttataccatgcatgttcgtctatgctg

SEQ ID NO: 896 - DNA, 295 bp, Trichoderma reesei
tcgagcggccgcccgggcaggtacgggacggtgagccagctaggcgtgtgaatgagcgtgcccgtatacgtggccagagtgaaccctgatacaaggagcagcggcacgcagaccatgtgaatggccacattgaccgagttatggtgataggcgccataaaacgtcaagtgcctttccagatccagagacattttcacgcggcccggagcggaagaaaggaggcgaagaacaaggccgggaagtgctcaacaaaatgcgaatggccaacctggagtcctgccgccagtccgaagaa

SEQ ID NO: 897 - DNA, 260 bp, Trichoderma reesei
gcgtggtcgcggccgaggtcgttgaacaagtcgtcaaacgctatctcgcagaatgcctgggcgctttcacgtcaccagctgccgacaggtcgtggtgcgttacacgcatacacctggctcgatgcatgctatggatgccgaagcatcacggcggtcagagacggctattaagcccttctataaccgggtcgaagtatgccacggatttgactatcttccatgaacaacttctactacttctgtctatctgataacttctc

SEQ ID NO: 898 - DNA, 195 bp, Trichoderma reesei
ggccgcccgggcaggtacatggccagacaacaaaaggacgtcagcaacaaagaggcttttggggtctgttttgatttgttcttcgtttggctttggattcggctgtttctatataacatggtctcatgatgctttaatggttatctgcgcaagttgtcgtttcggcggttttgatgggagtgagcgttcattgac

SEQ ID NO: 899 - DNA, 62 bp, Trichoderma reesei
tcgagcgggcgcccggcaggtacagcttctcggtgtagacagcggtggcttgcgtgaccagc

SEQ ID NO: 900 - DNA, 107 bp, Trichoderma reesei
gcgtggtcgcggccgaggtacatcagtataccagagtaattccgacgtggcctaacaacgtctagacagatgtcattgtttccttctcttttggtcttgcctaaccc

SEQ ID NO: 901 - DNA, 362 bp, Trichoderma reesei
gcgtggtcgcggccgaggtacattcccacgctcaaggccaactacgtcgtatggcccgcggtgcaggtcatcaactttcgcttgatgccggtgcaattccagctgccgttcgtttcgactgtcggtattgcgtggacagcctacctctccctcaccaacgcatccgattgaagcgagacgacaaaaaaaaaaaaaaggttgagctaacacgccacgcgttctgcggcatctagttgatgccaagatgatggaggatatacgcgatgattaaaagagtcggaatccgacacctagaatcctagggcgggtctggctttagtatatggcgagaggcgagaaaagaggtttcaagatcaaggtcg

SEQ ID NO: 902 - DNA, 299 bp, Trichoderma reesei
tcgagcggccgcccgggcaggtacggctgttgatggtttttatttcaaggttgggacatgttttcatttcgatggatgtgttacaagatgaagcggagtttacggatatcacgagcataagaacggcgcccacagcacccagcagcagacattataccaaggttagatgacttcaatacacagacatagaccgatataagcgatagtgtatcgtcagtcttctactctccggaaaaaaaaaaaaaaaaaaaaaaaaaaaaaaaaaaaaaaaagcttgtacacctcggccgcgcccacgc

SEQ ID NO: 903 - DNA, 433 bp, Trichoderma reesei
gcgtggtcgcggccgaggtaccttttaccctgacagccatgaaagatgtcaacgggtcattgcacgaagaggctgacagagaagccagtgaggagacgcaggtgtccacggtgcgcgtcaaggggctcctggatagatggatcaccttgaacctggttagagggctcttaccgcttgctggaacagccctgggctgctttgcattctaccatgagggattctgatggcacaaattgtcgctctgtcgatatcgatacgtgttccaccagcccagattgcctaaaaggctggccgcgtgtcgttcttgggttctcctgtgttctcgattcaactgtcaagatgcaacaagaatcaaacacgatgcctcattctacactaaaaaaaaaaaaaaaaaaaaaaaaaaagcttgtacacctgcccgggcggccgctcg

SEQ ID NO: 904 - DNA, 293 bp, Trichoderma reesei
gcgtggtcgcggccgaggtacaagacattaatcagagacgaccgggtgtttcctcgtcctacccttgtctcgtcttcctcgtatataagcccaagaaaagaaataattcagtcaactgtaacaatgcctgctgtatcagcccttattttgttttgttttgttccttcttccctcttggccaggctaatttttgttaagagggggggcatgacctccaaatggagatccgtcctgctcccactccatccctctccttctccccttctgtgcctccctctgagactcgttcgtct

SEQ ID NO: 905 - DNA, 490 bp, Trichoderma reesei
gcgtggtcgcggccgaggtggcgatcaagaagctctggaaggcgtgaggtggatgctgaagagaggaggaggaggaagaagaggagaggggattgaaaaaaagggagacatcttgatgcttcatgattcaagtgctgggggggtgaattgctcgcaggttttgggaggactgtgtatctgatttatgcgctatttgggccgcaagggctgtaagcgcctgtatagaagtactaacttgcattggggttttttcagacccaatgtggtccgaccaacctttcatcttcgactacgagagttttaggctagttaagccatcaccttaactactacctatcccgaagatatttattatcctcttaaagcgggaatttttaatttccctttatttattatgaaggatttatctccactttaaggccggcgaagaatatccatatactcacctgtacctgcccgggcggccgctcgagccctatagtgagtcgta

SEQ ID NO: 906 - DNA, 394 bp, Trichoderma reesei
tcgagcggccgcccgggcaggtacaatatactacacctttgacaaaagtccctatatatgacgagaagggtcgggtcttgctcggcacaagacttccccctctgctgctcctctcttgcctcccgaatactgaccactgtgaagacactaattattttttttctttgttcatcatgatgatttaccggaccagaaacagaaaacatggtcgctcttcgcaagttcaaatggaggagaagtatcaagtccaaagatgcctcgataacatgggttcatttgacactaacaacaaagatttgcacgcattactatttccactccttactcttccgtgacgttgatgcccagccctcagaccctcaaccttgagctcctcgccggtggcgcggcggta

SEQ ID NO: 907 - DNA, 226 bp, Trichoderma reesei
gcgtggtccggccgaggtacttcatcttggccgcaaacactttcccgcagtggacgcagatggaaagctcgacttcacacatggtcgcgcgcggtttgttcctgatgatggagacacatacgaagctactccggaacaagatgctctttggcgcttagccctcctgtgattggggtataacgatatgagcggcttcaagttggccagcgaaaaacttcttgagaaa

SEQ ID NO: 908 - DNA, 246 bp, Trichoderma reesei
gcgtggtcgcggccgaggtacagtatgacgagagagaacaaagaatgaaagaaacaagcataaaagagagagaaagccccccagcatcgtgagcatcttacactgcgatcaaagcccgtcgggagaataagagcgacagtcatcggcagtctttgatcgctaagagaatccgcgtcttagtcgccgtaatcgtcctcgccatctcctcccttgaggttggcgtccttgcggatcggaatcttgatg

SEQ ID NO: 909 - DNA, 258 bp, Trichoderma reesei
gcgtggtcgcggccgaggtaccctctcctccagattgtaaccgcgaaactctgtcttgatgcccagccgcagggcttgcacggctcctccaagattctctgggatccctggagtcgtgtgcagagacatggccagccatgcttctcgtgcgacggcttcggactcaccgtggcgaaggaggagagctactgcttcatcggcggcgacaatttcgaagcgcttttggttgttgtcgtacctgcccgggcggccgctcga

SEQ ID NO: 910 - DNA, 207 bp, Trichoderma reesei
gcgtggtcgcggccgaggtacatcacgggcatccagggtggcgtcgaccctgagcacctcaaggttgccgccacggtgaagcactttgccggatacgacctcgagaactggaacaaccagtcccgtctcggtttcgacgccatcataactcagcaggacctctccgaatactacactccccagttcctcgctgcggcccgttatgca

SEQ ID NO: 911 - DNA, 335 bp, Trichoderma reesei
gcgtggtcgcggccgaggtacctttctctcaagatgctgtctcaatcgattcgcggcggcccttcattggcccctcccttctctcattttgatcagatttgctgacctgtgccctctccgcgggtgtatcattctaggcttcacagtcatcctgaaagaggagaagaccagaatccgagaatacgaagagttgaaagccaaggaggcacagaagggcccctgggtccatttaccgaatcgcaaggtgcatggccagaggccctattactcgttgtagagacaaggagacgttgcggtccgagtgaagctttgtagcaaaccattctttcgaaact

SEQ ID NO: 912 - DNA, 57 bp, Trichoderma reesei
gcgattgggccctcttgatgcatgctcgagcggccgccagtgtgatggatatctgca

SEQ ID NO: 913 - DNA, 305 bp, Trichoderma reesei
gcgtggtcgcggccgaggtaccgtccgtcgtcaggccgtcgatgtctcccccctgaggagagtcaaccaggccattgccctgctcaccaccggtgcccgcgaggccgctttccgaaacgtcaagtccattgccgagtgcttggctgaggagctgatcaacgccgccaagggcagcagcaactcatacgctatcaagaagaaggacgagctggagcgtgtccgccaagagcaaccgataaaggttgtgcgagtgggttacctggcagggatggagtgtggctttttgggcgtggatcaggcatatt

SEQ ID NO: 914 - DNA, 227 bp, Trichoderma reesei
cgagcggccgcccgggcaggtaccaaagggcgaggatccctatgcgcctcagcaatccggcggctgctgtgtcgtcatgtaattgcgttttccgacgtgtggagggacgaccatcgatgatgaaggagctactggcgtgggatcgctttgatttttttttctcccttggtgtgtgaccaagggccttcttctttctctctctctttgattttacaacgcaatgccta

SEQ ID NO: 915 - DNA, 397 bp, Trichoderma reesei
cgagcggccgcccgggcaggtacattatttttaacattgtcgccgcgttgtttgtctactggctggctcgtgcgcccaagaagcagctcaagaacgctaagaagcccaagaaggcctaatcgcttctcttttgcggaaaagggaacaaaaaaaacagaaatgaattcgaacattggggttgcccagccatttctcccctctttcgatttacccatcatactctattttcccctttcaaacacttgagcgtcatatatgtcggatgtttgcacaccatattgcgattggagatactggtacataccgcagggggattgccgggtagaaatgaatgcttgattgtgatttaccgacgaaagtgagatgagaaagaatctgatagaaaaagcgctgacgg

SEQ ID NO: 916 - DNA, 295 bp, Trichoderma reesei
tcgagcgggccgcccgggcaggtaccacaattacctaaagttaaaataaagaacagtattcctaatataggcattaattgtgccatacctctgtagaaatagatagatctagttccagttctatcatataaaactcctccagcgcaaataaatagaccactagaaacgaatccatgcgctaatcctaatactacagaaccttccagaccctgaagagtattactgaatattcctattaaataaacagcagcatgacatacagaactataggctattaattcttttatatcagttg

SEQ ID NO: 917 - DNA, 61 bp, Trichoderma reesei
gcggccgccgggcagggtacctcctcggtcttaacactcttgtgaagtcgggcatcgtcga

SEQ ID NO: 918 - DNA, 58 bp, Trichoderma reesei
ccttagcgtggtcgcggccgaggtacagcataaaaatgtgcaaatggaatatcaaaaa

SEQ ID NO: 919 - DNA, 386 bp, Trichoderma reesei
gcgtggtcgcggccgaggtacgagggcgcctcaaccccacgtttcgctagttcgatgagcagcccatttcccgctcagccgatgactccatcgatgcccgtcgccttgggtctattgtgggtagcaaagcaagatgtgtttcgtgcgggggagccgatgctggggaagcgggttggagacccaaatctcgacagatcagaaatcccgaacaccgaatcttaagcaagcgctctcgtcgtagcaagcagcataattatcttccatcctgacaaacaaagatgcgttgtgcaacccgagccatttcgccgtgactacttgatccatctggcagggtggagatctgcgactgtgccccagatgacgaactgtccggacccccggctcga

SEQ ID NO: 920 - DNA, 374 bp, Trichoderma reesei
gcggccgcccgggcaggtaccctggatgggaagaaacaaatagccggtcgtcagtcataccatgggcagcacgagctgatcgcctccaaccatatggacattattaatgttgtaagtgtggtcatgggcgtcaatgtcaagcagtggatagagtcaaacgacgatgatatacaagagtctctgtattggagacaggcgttcaacaccaggacgtcggagttgtcgtcagtcgctcttgtttgcaagtgcaagacccccgccaaccccgataagacgctcgttggctgctcaaacaaggcgtgcgaggaatggatgcattacgactgcctgctcgacgatgtcctctcccgagtgtacctcggccgcgaccacgc

SEQ ID NO: 921 - DNA, 171 bp, Trichoderma reesei
gcgtggtcgcggccgaggtaccgaaccgccgtcgcctcgcttctcgagtccatctccaacgaggccggcacgcagtttatctgcaccacgttccgacccgagattgttcacattgcagacaagtgctatggcgtgacgttccgtaacaagacgagttccatcaactgcgtc

SEQ ID NO: 922 - DNA, 334 bp, Trichoderma reesei
tcgagcggccgcccgggcaggtcaagctttttttttttttttttttttttttttttttttggggataatgtcagattagaagagagtcgttatgtgcgttggtttttgagtatgtagctgccactcgaattaatggtggccataatcaggagcagagaagacagaaaagcgtcaacaccaaaaagctctcctaacccaaacgcccagagtcgcgaaaaacagaacaaagaaaaacaagtcatcagaaaagacccatcccgaaccagcgactgtcaaagtcccccccttatcgagactcgctctccttgctcttgtacctcggccgcgaccacgc

SEQ ID NO: 923 - DNA, 212 bp, Trichoderma reesei
gcgtggtcgcggccgaggtacattgcgttcctgactggcaaagcaaatggcctgtttgagaactctagggccgcggcttttccagaaagtggacatcaaggggcagatctgacttgttcgcatcgttccttgtcacgtccctcaggcgtctcttcctctccctgcgtgtttctttgcacacggctcacggccaccggtcgccttccttcttt

SEQ ID NO: 924 - DNA, 296 bp, Trichoderma reesei
tcgagcggccgcccgggcaggtacagcgtcagggttatcaatgcaatatgcaatacatacatgcctaggtagttggttacacaaacaatgctgcagcgcctcccacgatatcatctaattttccatgcgtttctctctcttttttctcctcctctgccattgacgccccattcgaacaaaaggcgaatctcattccgtctctgtgccgccacccttaaaggagttgggttcagcaacctaccaataggccggtctcagtcctgcaaagttggccattacggcggcagcctctccat

SEQ ID NO: 925 - DNA, 339 bp, Trichoderma reesei
gcgtggtcgcggccgaggtgtcattaccaactcctacggcgacgaggagcaaactgtgccgcggtcatatgccgttcgagtttgcaatctgattggtctgctaggactacgcggtatctctgtccttcattcctcgggcgacgagggtgtgggcgcctcttgcgttgctaccaacagcaccacgcctcagtttaaccccatctttcctgctacatgtccttatgttacaagtgttggcggaaccgtgagcttcaatcccgaggttgcctgggctggttcatctggaggtttcagctactacttctctagaccctggtacctgcccgggcggccgctcga

SEQ ID NO: 926 - DNA, 272 bp, Trichoderma reesei
gaattcgcccttagcgtggtcgcggccgaggtcgcggtcgaggttggacgagcctatggactggctgttctccttggaaccatgtttgttgggtttgccatgctgtaagacgatggtgcttgaaaaagagtcgtgcgattaagcaaacatttgggtgtgctcgggaggatcgctcataatggttgattggtttggtttctcattggagcgtgcgctttacattggtatccctcgacgttggcatatacgtacctgcccgggcggccgctcga

SEQ ID NO: 927 - DNA, 395 bp, Trichoderma reesei
tcgagcggccgcccgggcaggtcgctcgctaagcacctacaaactcaccttgacacttttgtcaatttcattctttaaccaacctccgcatctataatcctaatcaagctccctcgagtttaattcctaatccgacaaaatgaagttcaccgtcgctgtcgctctcgccgccgctggcgtctctgccgtctacgtcccacctagcaacgttaccgtcgttaccgaggtcgtcgatgtctacaccacctactgccccttcgccacgcagatcacccacggctccaagacctacaccgtcactgagcccaccactctgaccatctctgactgcccctgcaccatcacccgcccggtcaccgtcaccagcagcgttgcctgctacacctgcggtgctg

SEQ ID NO: 928 - DNA, 378 bp, Trichoderma reesei
gcgtggtcgcggccgaggtactcgtccagctgtggcacctcccgacacggcaagtgaacgaagcgtgactggttgtgaagcggatctcatttctcgactcgaggctcttgccttctaagctgaatgtgggcgaagaggttcatcaactgcttcagtcgcacccaggagagatttacggggcgtcgcagatttactttgacaatatccacaaatggatgcccatcatgtcacaaaagctcttctatcgaaggttgaccgagtttagcaaaaccaagcgtccggactttgccctcctcttgctgagcattgtcctatgtatccactgccctgcgagtggcacaacgcaagagccactgtacctgcccgggcggccgctcg

SEQ ID NO: 929 - DNA, 130 bp, Trichoderma reesei
gcgtggtcgcggccgaggtctcctcctcactgcttcgtcatgaaggtctctcgagtccttgcccttgtcctggggggcgtcatccctgcccatgctgccttttcatggaagaagtcaagctcggcggcgg

SEQ ID NO: 930 - DNA, 512 bp, Trichoderma reesei
gcgtggtcgcggccgaggtaggtaattggctctggaccatcaatcgatctgcgactctcagaagccctcttttggataacacaattcgagcttcagccgtcacttgcagagcccagccagccaaagcctttcatttcactcaacgagctagttcttcgactcacacctcacaaaagtcactaccctgcaacaaccctcgattttcgagcctcacactcagagccttaccactgtctttacactcacactcacactcacactcacactcaatctcatcctcacaaacccgcagcacaatggcaacctcaaccccagcctcctccgccgcagccctcatcgaatccgccaaaaaagccgccgcctaccaggccgtcgccgaccacctccccccaacggcaacctacgtcggcatcggctccggcagcaccgtcgtctacgtcgtcgaggccattgccgccaaggcccgtccttctccgccaacatgacctttatccccacggcagccagagcaa

SEQ ID NO: 931 - DNA, 167 bp, Trichoderma reesei
gcgtggtcgcggccgaggtacctagccgcgagaaatgccagcgatagaatatacctctttagccatcagctgtttattttaactaggtaaaatgaggagaatatacaggcagggtgtgctttgttttacccaaaaaaaaaaaaaaaaacctgcccgggcgcccgctc

SEQ ID NO: 932 - DNA, 166 bp, Trichoderma reesei
gcgtggtcgcggccgaggtacaaacgacttccacgccaaacgccgcagactaatccaagtcccaaactgttccaactcgtacagcgacacactcgtatattgcgaggaggaaaaaatattatagatggtataatggaagaagagtcgtataatgggtggtaggaga

SEQ ID NO: 933 - DNA, 568 bp, Trichoderma reesei
ggcggccgcccgggcagcctcatgctctatttccctccttcgccaaacagcgcctgcagagtgtcatagccatactccagctctccatgccagtagttgacagaatccgcctttgatacccgccaggcgtcgtccagcgcctgcacaacctcctccggcagcggccccttttccagatccgtcaggttctgctccagctgctgcacgctcgacacgccgatgatgatcgcgtcgtttccgtccttgaccctgagcgcggagtggtgaaccatccattcgcagcgcaacctcgatcagcgtcagcccggccttctcggccgcttcctcgacaatcttcgagcgcctcaaaggtggtcctgcgcggaagtatcgcttccggtagttggtcgcctgggcagtgtctcccgcaaaccgtcccgactcgggcttgatgtccctggacttgatcttgccggagaagaggccgccggcgagggggttgtacctcggccgcgaccacgctaagggcgaattcagcacactgcggatggtcagtgacactgcgactaagagggagaaattccagccc

SEQ ID NO: 934 - DNA, 569 bp, Trichoderma reesei
gcgtggtcgcggccgaggtactttcatagacagaatatcctctttccgtatataccatctcaggcatcaacgcccgattgtgttgtaactctaactgtaaagaatttccatgctgaacttttgtttgatgaagactgacgccgtgacaaaatgccgtcgcaaaaaaccaaaaccattgcaaaaacacacgaaaactttttggttacaagtgtcgcataaatcaaggctgctgtgctgtcgatgccgcgataacgtattatgactggggacgggggcaaagagcctctcagggcgctttcttttcggttgatcagaccaggtcgatagtgaccggcaaagaagacgtgatccgcctcagaaaacccattggcgagtcaaacggtttgttgcgagaaaagtcagaagtcgcagtaacctcagaaaatccagctccgataacacggctgccgtgtatggtcaatcggatccagatcagcaatgtctcgcactccgtgcaatcgaagcgtcatgacccggtgacaaaactacccggcctgatgacaatctttgaagtcccatctgtgagaagt

SEQ ID NO: 935 - DNA, 59 bp, Trichoderma reesei
aacgtggtcgcggccgaggtggaaaaaaaactccaggtcagcaattgccgtcttggtcc

SEQ ID NO: 936 - DNA, 241 bp, Trichoderma reesei
gcgtggtcggggccgaggtaccgacatcgtaaagctacctagcaaacataaccatcttcactcgtcgccttcttgaccgcaagtcatgctcataaaggcgtttgcataacaaaagaaaggcaaccataccaacccgcctccaatccatcaatcatcaaaccaacgataccgcgccaacaaaagcagcagagacgcattcatcgcaagaaacctccagcgacctgcccgggcggccgctcga

SEQ ID NO: 937 - DNA, 265 bp, Trichoderma reesei
tcgagcggccgcccgggcaggtacagccttcccgccagcgactacatcattgagatgtctggcaactgcatttcgtccttccagggcatggacttccccgagcccgtgggccccctggtcattctgggtgatgctttcttgcgccgctactactccgtctacgaccttggcagggacgccgttggtcttgccaaggccaaataaagcaggtagacgctttgaagggtgtgtgtatctaggaggtgcacatcctgtatgtttgcag

SEQ ID NO: 938 - DNA, 94 bp, Trichoderma reesei
gcgtggtcgcggccgaggtacttttttgttcatcgccttcttctccagacgctcatgccctctttcacacgcacctgcccgggcggccgctcga

SEQ ID NO: 939 - DNA, 227 bp, Trichoderma reesei
gcgtggtcgcggccgaggtctgatactacgtcctgcatgtgctcccgcgtgttgtagatgtcgtagtatcagtctttcaaaacactagtaagtgtagttcgatgctgggacatctacaacacgcggcaccatgcaggacgtaggccaagggtcaagctgagcaaccctcggccgatgatgctcatgcagcgggtcagggacgcatttttttcatgcaaagacgcgtc

SEQ ID NO: 940 - DNA, 301 bp, Trichoderma reesei
tcgagcggccgcccgggcaggtacagattcaatacaatacagagtattttctataaaagatttacaattagttatagatcactttgataaatatccattaatttcacaaaaatttggagattattctttatttaaacaagcttacctattacttattaacaaagaacatttaacacctgaaggtttacttaaaattatagcaattagagcatctataaacaatggtttatctgaagcattaaaagaagcttttcctgatgtcattcctgtcatgaaacctgtacctcggccgcgaccacgc

SEQ ID NO: 941 - DNA, 239 bp, Trichoderma reesei
tgagcggccgcccgggcaggtacgggaagccggtatcttgggacatttggtgcgctgttcggcgaatgcttgactacgtcgtgaccattattggccaaaccgacatgtctatctgggaggtgcgaggcgataagcaacgtttcaccatctcgcaaatcatgctctgggtgcatttgaccgcggccttcggcttgccgacaagagatgcctcccatgtccgaaacagggcaaaagtggct

SEQ ID NO: 942 - DNA, 62 bp, Trichoderma reesei
gcgtggtcgcggccgaggtacgccgcaggacgggcgccgactttcagctgttcccggcgacg

SEQ ID NO: 943 - DNA, 372 bp, Trichoderma reesei
gcgtggtcgcggccgaggtacatcgacccgacaagcagattcatgctcagcgcagcttggcaatcgcggtatggaaaggaaccaacaccgaggctctgatcgggtatgagattcacgttgtttcgcgcgcttaaggagacaagccggcatatgatcgaggtaacgaggatagggatcgctcttcgaattttgacgacggtagcacttgagacactctattagctaatggtgaacagcggcgtttatgggaggttttcttttttgcaggagtttgggctggtggattgcgaaagattggcttagtgctggggagttgatgatagtcgaagggggtgatacccaacggacggagaacctgccccgggcggccgc

SEQ ID NO: 944 - DNA, 565 bp, Trichoderma reesei
gcgtggtcgcggccgaggtacaggtcgccctgggagcagaactccatgaccaagaagacgtgagcatccgtctcaaacgtatcaagcaggttgacaatgtttgggtgcgatccaaggctgctgtggagggcatactcctcggatcgctcatcaacagcaagctcgacaccggtgtcgcaagcggcagacttcttagtcaaacacttgatggcgacagtttggttagagacgagatcctgggccatgaaaaccatgccgaaagagccgtggttgagtggtgagatggtctggtagcgacctccatcaaggaggaggccaccagtaaacttgttcctcaagcattccatgctgacgaaggttgaagatgatgaaataataaaatatcgtaatggaagggcgggaaaaaaacgtcaggaatgaagaaccaagagggagaagaatgaatcagacgcagaaacaggagcaagcttatttatacaggagtttgtgtggtaacaagatacgtaaaaaaaaaaaaaaaagaagaaagaacgatgaatgaccttctgtttatcgtgaataagac

SEQ ID NO: 945 - DNA, 213 bp, Trichoderma reesei
gcgtggtcgcggccgaggtacctggtgtggaggtatcgatgatgaaatgacaatgagcagaaaaccatccccacgagaaagattttttttttcttctttaaaccgcgcatgcaatgttctggggtcgcgtcgcaaatgcttgaaaaaatttccgcttggtgtttcatccagtcaaagcatgccagctggtcccaacaagccggtaatgaccca

SEQ ID NO: 946 - DNA, 281 bp, Trichoderma reesei
ggatatctgcagaattcgcccttagcgtggtcgcggccgaggtacacgggaatctgactccggatgccgtcctcatcaacgccaagtctgactggaagattagcggactgtctttctgtagcccagcagacaactcgaccaagcccacctcgatccagggcatcagtctgcatgaggtcctcaacctagatcccaggctgcccaagtttgtccagctaaacttggactacacctctctttgtttgtcatggataacaacctcaccccttctgccgacatgt

SEQ ID NO: 947 - DNA, 63 bp, Trichoderma reesei
agaaaagagagaaaaaaggaaagggaagagggatttgggagggatatatacctttggtaatgg

SEQ ID NO: 948 - DNA, 421 bp, Trichoderma reesei
ttcgagcggccgcccgggcaggtcatctctcccggtcccctcccattttgatgagcttgaggacggctttctggaaccagcagtgacgcatagaatcttcagactgagcatattgagctctaggatcttgattcaaagatataggaggagcaaggaaggagaaggatatcactctctgtgattcaacctcccagagcacagttttgacgtcgatatgatacattggttcaaaatacgacttcgataatccgataccaaatcttataatcaacattgcttctcataaaaacacatcccaaagaagagcaaaagtctgagcgaaaactccatcacacttccgccagcgctcactcaccatgggtgccctcacccgcatcctctcgcggccggtcaacaagccgtacctcggccgcgaccacgc

SEQ ID NO: 949 - DNA, 236 bp, Trichoderma reesei
cgcccttagcgtggtcgcggccgaggtacatctgttgccctcactgcgtaggttactgctaggcacctcaaacaggcaattggggcagtaaaacgttacggactcctccgtgacgcatctcgggcatcggatctgttggcagtcttcgcagtagaggaggtattcgattgggtataagctgtagtttgaccgcggggcttttggatcgaacgctcggtcgtcgtcctcaggatctg

SEQ ID NO: 950 - DNA, 78 bp, Trichoderma reesei
gatctcggacgccatgctagccaacgacattcgagacggtgatttggaagcggccgggtacctcggccgcgaccacgc

SEQ ID NO: 951 - DNA, 350 bp, Trichoderma reesei
tcgagcggccgcccgggcaggtactatagtattgtgaccgagggctaggcaggattcatggcagaattccctaatgcctcggcctttgctcgcaacaagccaacatcctgcttgtgcatagcggttgaatgcaatgccaggtcagcgagctggtccagttccatggaaacgtctcgagatggatgaaacaagtccgaggccggctgtcaaacagcatcgaaacggatcaacattctcctcgtcctgagtgatattccacggggcagttgtgtattgaagccgtcgagtggtgcatcttgtctccccaggagcctttcgttgaacgatttgctagcgcgccggcgtgttta

SEQ ID NO: 952 - DNA, 156 bp, Trichoderma reesei
attcatgatcccgcctcccaatttcacaccaattttgtgagccgcgaagcattaaagtggtcagaaggcctcggggtgcctaaatggagtggaactaaacttccaacattaaatttgcggttggcgcctccacttggccccgccttttcatggatc

SEQ ID NO: 953 - DNA, 237 bp, Trichoderma reesei
gcgtggtcgcggccgaggtacattcactctcaggagactctggagatcccagagggcgtcaaggtcaacatcaagacccgaatcgtcaccgttgagggtccccgaggcaagctctccaagaacctcggccacctggctgtcaacttcggccaccccaagaagaacaccatctcgatcgagatccaccacggcaaccgcaagaatgtcgccaccctgcgtacctgcccgggcggccag

SEQ ID NO: 954 - DNA, 406 bp, Trichoderma reesei
ggccgcccgggcaggtaccggcgccccagactacaccggcgctggcaggaaaacgacgacgacgactggtgcgggtgctgatttcaccggcaagatcaggctattttaatcatgttggtttaattcaagtttgtaaccttaacgtctctcccttgtggagcgacagatcaagctctagaatgtctatagctacatccatagttgcttggcctctaaagggagaggttactaagtatatgcttgcctcacgcttgttgagcaacggcttttttatgaatcatcctagtattcccttttctatattttctcttacgacgatgtttgcctaaaataaataagactttttgcttttgattactatcttgcgttatctacctatatcgaagtacctcggccgcgaccacgc

SEQ ID NO: 955 - DNA, 390 bp, Trichoderma reesei
gcgtggtcgcggccgaggtacccaaagagaaacccaaatacgagcaatgaggaaaggatccgtgctgaaagcaatgtcactactacaaggactcttgtagcaggccggggaaagcgagccctttcgtccgggacaccaacagcaccagacctgtgatttattcttggccaaagcccaccgtctcctccacggcaatggtgagtttctgttgcagcgtctccaaagtcttgcatgcgggaagatcgattcggttgaagtaggtatgcgccttgggaaggttagacaagtcaccggccttttcaatggtgaatcttctcgggccgtcgctgccctggaggtccttgaatccgttgaccgggattctagaagtacctgcccgggcggccgctc

SEQ ID NO: 956 - DNA, 171 bp, Trichoderma reesei
agcgggcagcaagctgagaagccactgcttgttggaggggagatactccagaaagacggccgtatcaaggatcaaattgccaccggctccaaacgcggctacggcaatcaagacacccagcccggcccagttgggagctgcaccggccgcgatacctgcccgggcggccgc

SEQ ID NO: 957 - DNA, 110 bp, Trichoderma reesei
cctctctacgttttgacgttgtggcacaacaagtctggcgatgctcttcttcctattgttcgttaggtcgctatactctttccttcttcaaccccccttttttttcttta

SEQ ID NO: 958 - DNA, 212 bp, Trichoderma reesei
ggccgcccgggcaggtactggttgccgggacacttgcacgtcttggtcttgtcgtcaaagacctggcccttcttgttgcacacgcacttcttctgctggctgtcaaagtgagcgtccttgccgcagttttccacgcagtgcttgtcgtcgaatatctggccatacgggcacgcgcactccttgccgttaaagtacctcggccgcgaccacgc

SEQ ID NO: 959 - DNA, 259 bp, Trichoderma reesei
gcgtggtcgcggccgaggtacttgattttgaagtcatcttcgagaatcttctccttgggcaagtcttttgtacaagcttttttttttttttttttttttttttttttatgcattttacattttcaattcctggctacctaactacacaccgctgtcaaagcagtctaacccttggcagcaccggccttgatgagcaaaatgtcaccatcctccacgacggaatccttgcccttggtcatgaccttgcccttggccttga

SEQ ID NO: 960 - DNA, 440 bp, Trichoderma reesei
tcgagcggccgcccgggcaggtacatctttgatagtctattaggggaaaaaaaaggattcgcgactcctcccaggtgcgccgtatgaagcatatcgctttgccaccaccccttctcaagtcggtatcgcagaagcgctcatcgttgccccattcaggcgttctgcagcgtcgtttctctttctcttttgaggtatgtatgggcgagaaagggggttaggcgcgcaaggagaagtagccgatctctcttttcaaggggcaatccgtgcctccttgaaagacaacggacaaagggaaagttaagaaaattggcatggaatcctccatgcatgcatgaaactctttcggccgcccactctactgagctaaggatatcatgacactcgcgtggactcgtttccccccgtcttgatgtatgcaacagacccagaacagaaaagaa

SEQ ID NO: 961 - DNA, 256 bp, Trichoderma reesei
gtacacaaatttggtcgccgcaagctactaatgttctccagtgctgggatgtcggtatccatcgccatcatcacagcatgcactgcactccaggctggacgacccgcggttgggggaactggcatcgcttttctttacatcttcctaattgtttttgctttcgcttggactccgatgcaatcactctaccctgtcgaggtgctctcattcaattcccgagcaaagggcatggcgtttctagcattcatgaacaatg

SEQ ID NO: 962 - DNA, 200 bp, Trichoderma reesei
cgagcggtcgcccgggcaggtactcccagtgtcttccttgagaaggcccaagatagccatgtctctctagcattcttccggcgtcagtctgatctgcctatttaatcaggtcagtcaatatgtatccagagataataaattatgtatatcaaaaaaaaaaaaaaaaaaaaaaaaagcttgtacctcggccgcgaccacgc

SEQ ID NO: 963 - DNA, 450 bp, Trichoderma reesei
gcgtggtcgcggccgaggtaccttcgtttcgtgccaaatgtctctcaggactctctcgacttctactttctctgacctgaccggcacatcctcgtggggacagtattctagccgccaccactgatcaactgctggtttcagatcttctgcttccgtagactccggctccagacgttggcagacgtaaatcacatctctctcggtcgccacgcctcgcagctgatactttttgcatgtcattggctttggtcggccttgtttgtccgggtctgtcaggagccttcccaaaaagcgttgcttagcttgaagctgctctagctgagcacggaggtcttgtgtttttgcttccatatcggacagtatccgctgtgtcagtaaaagcacgtcgttgacctgtccggaaagattgacctgctcctcggtcatttgacctgcccgggcggccgctcg

SEQ ID NO: 964 - DNA, 146 bp, Trichoderma reesei
tcgagcggccgcccgggcaggtacattgagggcggcgaggacgaggagtaaggatggcatcgcagatcaagcttccggttactatggctagaatgggcgcggcgtgggagtgtctgaggaaaatgtacctcggccgcgacccacgc

SEQ ID NO: 965 - DNA, 70 bp, Trichoderma reesei
gacattgcccgcaccatgcgctacaagtctttcgccaaggagctcaagggtacctcggccgcgaccacgc

SEQ ID NO: 966 - DNA, 446 bp, Trichoderma reesei
gcgtggtcgcggccgaggtacggcgtcactgactctgacgtcggcctccgatggggtccctttgaccaggggaatcgtcacgctcacaaccagctccaaggagtcgcgggtttgaaaggctacctcgagaggcttcccaagttctcgctggaggaggatgaggtgaaaggggatttcggaggaggaaaacaagcaccactaccgggcattctggaatgacaagttttgccaaggatgataggagggtagattgtatgttttgaaccgacattgttgaaaagcagccgtctgttttagacatagaattagagtcatcgatggcgagtgcagacgttcgctaaggctttgtaagctgacccgagtttggtcaccataactgttgcatcgtttcatcaaaaaaaaaaaaaaaaaaaaaaagctttgtacctgcccgggcggccgctcga

SEQ ID NO: 967 - DNA, 122 bp, Trichoderma reesei
cagacagtagatgcatagcgttgcagcgtggtttttggttggaattatcgatacccttgctgtaaatatttaggtgctgttttggtagagagaggtttaaaacacagacatcctcgtgtgac

SEQ ID NO: 968 - DNA, 206 bp, Trichoderma reesei
gcgtggtcgcggccgaggtacgaatacccccccgtttattgcacgtcttgatgatgttccgttcgtggctggaaagccgcagagtatgacggagaaggagggcgttggattcaggatcccgctcgagctctcctgtctgggtagggtttttttgcattgggttagcatatgacttgagaatgggccaaaggagcctgccgcggaca

SEQ ID NO: 969 - DNA, 148 bp, Trichoderma reesei
atggctcatttcctccgaaacgacaacagaaagagggaacaggaaaagacatggtataccatctcaccggagatgcaaagaaatgacccaaactccagaaagccttgacggacatgacgacagatgctgcaaatgtgacgagacaaag

SEQ ID NO: 970 - DNA, 110 bp, Trichoderma reesei
aggtactacatcgtcgagaactttggcacctacaacccgtccacgggcgccaccaagctgggcgaggtcacctccgacggcagcgtctacgacatttaccgcacgcagcg

SEQ ID NO: 971 - DNA, 509 bp, Trichoderma reesei
gcgtggtcgcggccgaggtggcgtggtaacggacccgcactggacaggcccagcaaccaggatcatgcccagagcactgccaaagagtatgtgataacgcattatgtcgaggaggtatgtgtagatcgcacagcgatgttttaatccaagaagaaaaaaagaaaaaaagaaagaaagaattcggagacggcaaggatcagcaaatcgacacctttttgtgtgttccggtgagcggctgcttgaacaaatagctgtgaacgatgcttgcatgctcgagattgtgcgccaccccccccgccgcgtgttgttcaacacacacaaagggcagggtgtgtgtgatatccggatagattgcgcccgcagaccgttccagaagacgaggaaacaatcggaagcagcaagccaagaaatgacaaggaaatgtaaggaaaagatggtagatggaagcacgtcttgcctcgagggactgaagctcactccaggtagtgaatgagggcgaggaggggaca

SEQ ID NO: 972 - DNA, 327 bp, Trichoderma reesei
gcgtggtcgcggccgaggtaccgaacaatctccggcttcatgaactatagccgtgctatcaagctgttgtatagagtcgaaaaccctgaagtcgtgcaaatgttcggtggcaacacggataagctggagcgcgaattggagcgcaaggcccgccgcaagttccgcatttgcgtagccatgcagcgatattccaagttcaagaaggaggaaatggagaacgccgagttcctactgcgtgcataccccgacctgcagatcgcctacctggatgaagaaccgcccgttgctgaaggcgaagagcctcgactgtacctgcccgggcggccg

SEQ ID NO: 973 - DNA, 52 bp, Trichoderma reesei
cgcaccagggagcgaagaactcagccaggacgaggtcattggagttgatgaa

SEQ ID NO: 974 - DNA, 256 bp, Trichoderma reesei
tggcggccgcccgggcaggtacatccgacgagatagtagtcggtgccgtcaagtcggaagttcttgttgcactcgcggccgctctcgggtccgatggcgacgtcggcttggcatgggttgatgccctcgatccacgccacattgtaaagctttcgaggtcgaaatgatgaattcgatgtgactgaaaggctttactgtgcagatagacggagatggttctgcctttttatacccaaactggatatataggattggt

SEQ ID NO: 975 - DNA, 349 bp, Trichoderma reesei
gagcggccgcccgggcaggtgactaacccagccaaaccaaagcaaacacacagccagccagatttctttcgccgcttcgaggtcggaggaaatttgtgtgttttcttttctttcatcgttccttctttctatttcttttccataccccccgaaaagaatccgaaacgatgtcgtccttcgagtcggttgttgtcattgacggcaagggtcacctccttggccgtcttgccagcattgtcgccaagcagctcctcagcggtcagaagatcgttgtcgtccgctgcgaggctctcaacatctctggcgagttcttccgcgctaagctcaagtacctcggccgcgaccacgc

SEQ ID NO: 976 - DNA, 624 bp, Trichoderma reesei
gcgtggtcgcggccgaggtagacgtttgattcagcagagccactacgggcagcgttctgaagagaagaacaccaatggcaagaagatgagatgaacagcgaaaggaagccaatcggctgcaacgccattaccggcacgaaactgagattctcttcgcttcagcaagcttgagcgtgtttggtgacgcttttaacatcttcgtcttacccgactgctgattcttcttggctgatttcctgtcttccatcgtgggccttttactaatccgatccgtcgggatttccctatctgtatagagtcacctggacatgtcccagcaagcaacacgaatgcatagtgggaaaggggtgacgtgactaatttcttttttttttgttttcctctcaattttctttgtcaagggttttcaaggttgatacataaaattttcccccttcttattttccaggagctgatccagggggaacaaggggaggctttacggtagctggcgttttgatcatttccgaccccccttcatttgcacaagtgctgcatggagaaggcggactgggtcttgatatatgttttcgggatcaaggatggctgttgggatgtttggcatgtatgacgtgtttgtgtgta

SEQ ID NO: 977 - DNA, 250 bp, Trichoderma reesei
gcgtggtcgcggccgaggtaccaccacgccaccgaatttttcgaacggctggcgaaagctgaaatttggcactcaggtcggcgacggctttgcgcacaaagtccggggtgacattcatgatgtgtagttgcgccatgttgcagaggagatttagatacacccacccatcttcgtcaatgtgaacgtcgtcataggtccgttctggcggattgggtagcagctccggagggacaagacccaagtgtcgaat

SEQ ID NO: 978 - DNA, 516 bp, Trichoderma reesei
cgagcggccgcccgggcaggtgaacattcccgtgtccaagcaggacttcccgggcaaggagcgggatatgcccaatccaaagccaactcgcgatgagcttcccgaagctggcggaactagcgtgacctacaaagcagccaacaagctcgagggcaaaagggcactcattaccggtggcgatagcggcattggagcagctacggcggtgcttttcgcaaaagaaggcgccgtaattaccactgtatatcttccggacgaagagcaggacgcacaagacaccaagaagcaggtcgaagaggctggaggaaaatgctatctgtttgcggcggatcttgtcaagaaagagaattgccaggcggcagtggactttgctctagagaagatgggcggtatcgacattctcttcaacaatgccgcctatcaaatgatggttgaggatatccttgaccttcctgacgagcaatgggttcacacgttcaacgccaacattcactcgtacctcggccgcgaccacgc

SEQ ID NO: 979 - DNA, 250 bp, Trichoderma reesei
gcgtggtcgcggccgaggtacaaagctttttttttttttttttttttttttttttaaacgcaagagatatgcttgtattagcaggtgctttcatcttgctctgtcattgtcccacccgtttccactcgcgacccagtccccgtctactgattccccgtggtgagaaggctctggggatcataaacattcttggtaatcagcttcggattcgtgaccccaccctgcctcagcgacctgcccgggcggccgc

SEQ ID NO: 980 - DNA, 242 bp, Trichoderma reesei
tcgagcggccgcccgggcaggtacggagacagcttctcgagttggcgagtaaaagcccggcggcggtcggtgggagattgttgcaaaggtgaaaagcagaggtcgagggtggcgggtttggttgggaggcaggcaaaagagctcggcggcagagttttggaggggttcgaagtgcggaggtttcgcctcgacttgaaggtatcgatccatcccgatagtaggtacctcggccgcgaccacgc

SEQ ID NO: 981 - DNA, 559 bp, Trichoderma reesei
tcgagcggccgcccgggcaggtacaagacaatgcccaacttgcccatgagggcatcctctccgcactgcttcatcaccatggcgattcgggagatgaggtcggcggcctgctggcggacagtggcagacttgttgttgagtctccagaggattgtgctcacgatttggggcaggtatggcttgcagcgggttccaagggcgttgaccaccgaaccgaagccgttgagcatgacaatgtcttcaacgctctgttcttggaacgcgtggaggataccgtcaatcaggcgttcttcgagacgctcgccaatgtccgcgggcacccagactggccacgaccttctcgaccgtctcgacagtcatctttcggtaagcctcgctctcatccttgaggttgttgacaattctctccaagatctcgctcacgccaaccttctggccaatgtcgactgtcgtctcgacgactgcttgtagttgcgcttgtcgagagccattcgccagacccagaagctcttgaagaatccgtccaggacatgctccttcaggtagccggccgtgactc

SEQ ID NO: 982 - DNA, 385 bp, Trichoderma reesei
tcgagcgggccgcccagtgtgatgggatatctgcagaaattcgccccttttcgagcgggccgcccgggcaaggaaccagaaactcgcatttctaatgggcttcatcacaatatctatgagtcccagccatcccagtcatctatatcaacgccatctacagtatccgcttgacaaccaactcccctttatcccctccctctaattctatcaacccaccagcctccagcttcttcttccacttactgctctcataccgtcccaaaatcatcgtcaatcgtaataccacgccattgctcgaggaatgctcctccgcgctctcagccaacggcgtaaacgtccaccggccgaacgcccagttcaagatgtacctcggccgcgaccacgc

SEQ ID NO: 983 - DNA, 49 bp, Trichoderma reesei
acagagagatggatttcaagaccagcaagtccatggcgaactactttgt

SEQ ID NO: 984 - DNA, 396 bp, Trichoderma reesei
gcgtggtcgcggccgaggtgccgacagcatcatgaagatccagaaggagctcgacgagaccaagattgtgctgcacaagacgattgagagcgtcctgcagaggggggagaagattgacgatttggtggctaagagtgatgggctgagtgcgcagagcaagatgttttatcagcaagcaaagaagcagaattcctgctgcgtattgatgtagaggttcttttatatggcgttgcatacggtcatgttttcttcagcaatgaatgggactgtttgttttatcgaaagattggtttattaaaagacagacacccccccacattacgcgtagcacttgagctggatctttccccatctctaatacatatgatagcagcagtagagagagtgtgtgctcac

SEQ ID NO: 985 - DNA, 384 bp, Trichoderma reesei
gcgtggtcgcggccgaggtacaaaaaaaaaaaaaaaaaaaaaaaaaaagcttgtacaaaactcgcatcaaaccctatagaaagcaaaaatactccggtggagttcggcatctgggaatctagaaagcctgggatcaaaaccccagtggccttctctcctcgtccgaggcatccctcacgtcggaggcttatcatctcctgccagaagcaatcagacatcgagatagtcttcctagtctaacagcagagttccttgagagagcaaagaaccaccgtgaacagaccatcaagtcggcattcaccttccctaatctgaagccaagagagataacgataagtcgagtcccagagattcgcaatctttgcccggcattgcctgagcccg

SEQ ID NO: 986 - DNA, 327 bp, Trichoderma reesei
cgagcggccgcccgggcaggtactcgtctgggggagggcgctcgccctcgccgctgtcggctcggtagtcggggcgggatacctgttcgtcgtcgtccattctagtggaggaggaaaacagtggcatcgttggtgttgtttggagaggctcttgtgagggatggtggatgatggaggctaggtatctggaaccagcagctaccccatatatcccaatctctcagattcgaacagcttcaattcgaaaggcccgtcgcttaaagaaggaaggagaagagaatacaaagaagaaaaaatcgtcatccgcgacctcggccgcgaccacgc

SEQ ID NO: 987 - DNA, 424 bp, Trichoderma reesei
tcgagcggccgcccgggcaggtacagagtatcctgatccgtgcggcaaccccatggtattcttctcttatggccaagctcggcgtatagacgagggcaggtcgtctctcgcatgaggtgctagtagatgatccctactcgcagcaaagagtggagggacatcttcgacgaagagaggagctgggggccctgctgaagagggcacgagtcactatggacgtgagagccgatcgtgcatgacagccttcggctctactctgtgtggcctgcagcaatcccacgtatacgacgtattcctttgcctttttggcggagtcgagctcgggagagaatgctacgatgtcgtctcgcattaaattagcagtaatagcctgtgccgcggtctgtggaaggattggctgaaagtacctcggccgcgaccacgc

SEQ ID NO: 988 - DNA, 219 bp, Trichoderma reesei
gagcggccgcccgggcaggtacttcttgatgagacggttgaagtgcatatatgtgaagatttggccgggagcggaaccaaagtggccgagcagacgagccttcaagtgctccttcttgaggggctcgcgaaggagggggttctccctcaggtagatcatgcccaaggccaggtagcagctggccttgaagtagtcattgtacctcggccgcgaccacgc

SEQ ID NO: 989 - DNA, 305 bp, Trichoderma reesei
gcgtggtcgcggccgaggtacctcgaccaggacgcctatatcatggatatgagcaagtcgctggaggaacagctcctgaatcggcaaaagctggagagcctgatgatcaagaattaccccgttgtgccgccggacagcatcatcaagacgttttcgcacctgagaccagatgaggtcgacctcattgttagccaggacagctcaggcttggtggccggcagtgttgtggttaggaacagccaatggagcaagttcctgctggagacgtggatggaccctctgtacctgcccgggcggccgctcga

SEQ ID NO: 990 - DNA, 253 bp, Trichoderma reesei
gcgtggtcgcggccgaggtactgctgttaccggcagacaagaagcgggttggagctggtttggcctaagagagagctctgttggacatgtaaattgtttccacctagatcgctagactcttcaagatctgtcgaaatcttgcagcctgtgagttatcgtgttgaacaacgaacaatgccaacaattttgcaggttggataaaaaaaaaaaaaaaaaaaaaaaaaaaaagcttgtacctgcccgggcggccgtc

SEQ ID NO: 991 - DNA, 386 bp, Trichoderma reesei
gcgtggtcgcggccgaggtacagcataaaaatgtgaaatggatatacaaaatctcatgtaacacccatggtcatgctaccatcgggcataactggaattatacatcatgttcgggacatacccaccttggctctgaccgctaaagactccttgattgactccggtgttgctttgcgtttggtgctgcatcctcgcctgcagtatactcgggtccgcaagatccagctttccaccatcatgaggctgattgccactgcctcggctcctgctaattaaactcgcaataaatcgccagacccccccttcgcggcagtgccaaatccggagccaccaaatccctgaccaaagagagggggtggcgtgttggtagacttaagtccaggcgg

SEQ ID NO: 992 - DNA, 424 bp, Trichoderma reesei
gcgtggtcgcggccgaggtacctagtagactacgatgcgcttcctgtagcgcttctgaggccttatggcactcttagacattattcagatctaaagccttggtataacgcaacgtattgcattcgttggaaaagctccccgttaaaaaacgcttccctttaggtctgtgaagctcaaagcatacaaggaaaagtaatcagtccagaaacgccccatacctgtgccgggacgccattgctcttttcaaacttccaattgaaaacccagatgttgtaggaaaagcaaagcgagaaatgagaacgagaaagcagagaaaagggaacagatataccaccaagccctttcgtgacatgtaatcgtagtgatagatgccgtatacgcagagacgatgatgagtgtctacacctgcccgggcggccgctcg

SEQ ID NO: 993 - DNA, 177 bp, Trichoderma reesei
tcgagcggccgcccgggcaggtgtcgtcaaggtcaacatggacaccgacatgcagttcgcctacctgtgcggtatccgtgactacgtcctcaacaagaaggactacctcatgaccaccgttggcaaccccgacggcgaggacaagcccaacaagaagtacctcggccgcgaccacgc

SEQ ID NO: 994 - DNA, 236 bp, Trichoderma reesei
gcggccgcccgggcaggtactggtaatctataaccccaaggccctcgaggcctttaccaagattcgggccacgctgggcggagagattagtgcagttgccggtcccgtcggcatgggcggtgttctagagaacgacggcaagtggaagcaagcaaacaggccggttttcacatacctcaagtcgcgtggcttctatgccggtgtccagttcgacggtacctcggccgcgaccacgc

SEQ ID NO: 995 - DNA, 260 bp, Trichoderma reesei
tcgagcggccgcccgggcaggtacaccttgaaccaccgctctgctcaaccgcctccctcgcaaatagtgggaacctgggacgtcaaagagcaggatttgcgccgattcttccctgcggacttcgccggtcccatatacctagaggtgcttgcgctggcgaaacaggactttgtggagaagactatttgcagaggaaagcccatccgcggtatcgacagcaccgatatggtggtatcagtcgccatctggcgattcctcca

SEQ ID NO: 996 - DNA, 312 bp, Trichoderma reesei
gaagctgtattactgtgtaagtaacggattaatcatccattatttacatcacgcatgatatgttctatagaattgaatgcttctgctacactaggggtataatgcatagctaaaggtacacctgtaactatttgtataattaaaccactgctcataaagaccacagtttcataattacctatattacctggttgtgaagggcattatatactattaaccattttataaagggggacttttgatatcctctttttattttataaatatttttgggggcgagcccttattatacttatatataataaaatactt

SEQ ID NO: 997 - DNA, 301 bp, Trichoderma reesei
gcgtggtcgcggccgaggtactgctgaagcggtatcggtgacccttccaatggtgttgccgacatgactgcggacagtttctagcttacctgtccttggggcatctaaaatcttgtcgatacgcttaaaagttgcggatagtctctattacgaatatgtatctgtgggcaactcatcagacaaggacggattgggacgaatctgtagagtctggaaacccgatccaccatcaactacgcaatgcgaagcgggcggcgagtcacgcatcatcaacacccacgacggagagtagaggacggaa

SEQ ID NO: 998 - DNA, 259 bp, Trichoderma reesei
cgagcggccgcccgggcaggtcagtccttttctaggtaatcgagccagtcagtcctttcaacatggtttccgcttccgctggtcttgcggccgttggcctcctcaacggctactggggtcaatacaccaccaccgaaggccttcgactcatgtgatagtggcgttgattccatcaccttgggtttgtcaacggtgctcctgatgcctctgggtatccagcctcaatttggaccaactgctgggcagagtcttatccggg

SEQ ID NO: 999 - DNA, 365 bp, Trichoderma reesei
gcgtggtcgcggccgaggtacaaactgtgatcggaccttctgaagaagggcttgctctgcctcggaatgaatacactcggtatagccatggtccaccacgaaggtgatatctgcgaacaattagtgctccggctgcgactccctgcgagaatagaaaaaaaatcgcttgacaacggtgaagagctggagccttacaatgatccaccagagcatcctccgagtccgatataatcctggctgaggtctggaaggggttcttcctcgtggacgttacagaggtctgtgggttgggtatccatgtgttaagttcgatcatacgagcaccctcgcgattctgccgctgccgtacctgcccgggcggccgc

SEQ ID NO: 1000 - DNA, 135 bp, Trichoderma reesei
gcgtggtcgcggccgaggtcaagtaagctagtagagaatacgaaggcgtaaatgagctaacaatcataaaggaactcggcaaattgactaccgtaacttcggaataaggagggctcattattcttgatgaatatc

SEQ ID NO: 1001 - DNA, 61 bp, Trichoderma reesei
gagcggccgcccgggcaggtactatgtcttggaagacaactttggcttttcctctggcggc

SEQ ID NO: 1002 - DNA, 324 bp, Trichoderma reesei
ccttgagcggccgcccgggcaggtacatgtggattaaggcaggcatccccgtgcacgactcttcttcctcttcgagggctactccgagggcttccacggttacacccaggagcagctcgaccacttcgactgcactggccagtgcgtctactttgtcacgctcgtcatcctccaatggggcagcatcctgtctgggcggaatcggcgccggagcattgtccaaggccgatccgttcaccgggaagagacgcaagccttggcttttgctgagcatgatgatcagtcttgccattgcaatcttcgtcactgagggtccgggcattc

SEQ ID NO: 1003 - DNA, 359 bp, Trichoderma reesei
tcgagcggccgcccgggcaggtacctagatcgacgaacactgatgatctgggcactgggagtaattattgaagcgagaaaagggcgccggcggaaaggacagggacaaaaatgagactcatcagtccactgccgtcatgcgcttcgacaatgatgacctctactactcagcaacatctaaatcgtcatgggcagggagaggactttcagctttcctttcatcaccgttggctccattctccttacggtcacgatcatcacgctcgtctttcatatcgcggtcacggtcacgatgctcgggactccgagagcggtcgcgatctcttcggctgtcgcgatcgacctcggccgcgaccacgc

SEQ ID NO: 1004 - DNA, 265 bp, Trichoderma reesei
gcgtggtcgcggccgaggtacatgggccagccgtaagaagatcgctaagaatgcgatgtagaatcagaatcgaagaaaagggaagattagcttgctttctgggaaatgccctttgccaaagaacgttccacgggtgttggtgggtcgtccttgacgaggtgttcgacatccgggacaatttcgccttcgctaacaatgggaaaaggggtaagaacgtggctaatgtctccccaccactgctcgccaaagcgtcggtttttgtaca

SEQ ID NO: 1005 - DNA, 75 bp, Trichoderma reesei
gcgtggtcgcggccgaggtacggccagcgcgacaagatcaacactgtcaagcagtaaagattgttgacatttttt

SEQ ID NO: 1006 - DNA, 373 bp, Trichoderma reesei
gcgtggtcgcggccgaggtccagttgtctgtcggcattactctgtccgcaccccggagttattatgcggagttttacgaggccagtttccccgctatcgagatcagaggttgcaggacagaaggattcagcttcatccagaccttgttgttgttgatgtttgttgaaggcttcaatttttttgccatcttgcggggtatggggaacgagatggatgccgctacggcgacatgcagaacaatcagaccaccaaggtattaaaacgatgcttggatagagccggtttgtgccaacctgtaggtcaatcggctatggagatggtgatgtgtcaactcttcttgcttggtcgttctgccatgtacctgcccgggcgg

SEQ ID NO: 1007 - DNA, 184 bp, Trichoderma reesei
tcgagcggccgcccgggcaggtacaagccagatgggtcgggggattacgccccagcatctgatgtcactacgccctcaatctgggtttagcgagcaggtcccttcaagccttgctggccaggctgcctttcaaaaccagggccacaatcgtcagtcatctcgattcaacttcatggctgacagt

SEQ ID NO: 1008 - DNA, 121 bp, Trichoderma reesei
gagcggccgcccgggcaggtaccacagccagcggccgctgcgggtcgtgatcgggggcaggccgaggatctcctggaagacttcgacgtagactgtcttcatgccgacgttcatgtcaagc

SEQ ID NO: 1009 - DNA, 283 bp, Trichoderma reesei
tcgagcggccgcccgggcaggtaccagggttcgaggccccgaatcccgctatttttcagtcgctcagggcagtgcagacgccgttcgttcggggacagccgtgtccaagtagaggcgcccgcagagagagggagagagagagaggttcttcctcgtcttcacaccccccgagagagagaaagaagaaggcccttggtcacacaccaagggagaaaaaaaaatcaaagcgatcccacgccagtagctccttcatcatcgatggtcgacctcttgcgcgaccacg

SEQ ID NO: 1010 - DNA, 293 bp, Trichoderma reesei
cgagcggccgcccgggcaggtaaagggtcgaggtcgatcaattcgcccctcagatatggatagtatgggggtggcgagagaggagtataataagactactgggggatctaggccaatggacttgtcgagatgcgctattgccttttaattcgtcgcgggtcgttggccaatgctctgcttggaatgtgctgattgggtggaaatgcacaaccacgtgagctctgactcgatataattctggcgtatcagacgtgggatatggcagctcgtcggtacctcggccgcgaccacgc

SEQ ID NO: 1011 - DNA, 480 bp, Trichoderma reesei
tcgagcggccgcccgggcaggtacaagatattgttttcgtttccacgccgccggcagggttcacccatgagggaacgatcccaacactgcggttcatgtgacaggtatctccttgcctggaacaattctgaaaagctatctgccccttgcagttgatccgacttgctatcgaatccggaaccacccgtagtccgctgaaaccgggagaagatgatgtgctagtgatgatagtcggtgacttgtcgacaatagcttcgtccctggcgagcaattggcaacactatccgtatcgatttagaccgacattttctttcctttcgtctgtccgatttcatggtatcctggtcggagagattgtggcgtaaaagaatagggctgacggcggaggcagccggtagtataagaatagagtagagattgtatatgatgccaagaaagaaggcttcagctgaactccggcagcccagcttcccggtatcc

SEQ ID NO: 1012 - DNA, 299 bp, Trichoderma reesei
cgagcggccgcccgggcaggtctcgatgatatatgataggtggaatagcaggcgagtggtagcgacagccagaaggtaaaaagcaaagttccagcccctgccgtcggaatatgactccctatggatgatgctctttatcaggacaccgtggagtccggttcgcagccggtcgtcccccccggttgagtcagcccctcatcaaagtccgcctctcgcgatcgccagcaatcaccaccgatcgaaaagatctcggataccctcggatcttggccgtgccggtacctcggccgcgaccacgc

SEQ ID NO: 1013 - DNA, 321 bp, Trichoderma reesei
gcgtggtcgcggccgaggtacggccgggttttccgctacttcgttatctggcaaaacatgggttctgccattcttactttattttgtctattggtcctttgcccccctccgccttactgactttcacgttctcctcttcttctccttctgccggacttagagagatgtgtgtatgtgcttctgcgtttgccgggtggggaaaaccgaatcactggatggtctttgccggcgtgggcaacgggctgttgtcttcctcggcgaggctgcgcgccgtccgcctgccactgattgactcataatttctctcgtttacctgcccgg

SEQ ID NO: 1014 - DNA, 278 bp, Trichoderma reesei
gcgtggtcgcggccgaggtggccgctgccgcagtcttccttttgtaagcaggataagctaaagtgtgtgtctttttgggctagaacatcggcacttgagagtcactctcacgatgttcggaaacgtgtaaatagtatgatttagagctggcttttttattgctttattctatacagccgccagatccgctagatttggatctttggaaggcttcaatggtaacgaacaccatttttattttcttttcaaaaaaaaaaacctgcccgggcggccgctcg

SEQ ID NO: 1015 - DNA, 338 bp, Trichoderma reesei
gcggccgcccgggcaggtacaaatcttatttaatggttaaatgagtagtgttacattgctgtttgttattgtatctattatagctttattatttttagttcttaattttattttagctcctcataatccttatcaagaaaaatatagtatattcgaatgtggttttcatagtttccttggacaaaatagaagtcaattcggagtaaaattctttatttttgctttagtttatcttttactagatttagaaatattagtaatatatccttatggacttagtagctatgaaaatggcgtatacggtttaataattgtacctcggccgcgaccacgctaag

SEQ ID NO: 1016 - DNA, 214 bp, Trichoderma reesei
cgagcggccgcccgggcaggtacgacaactacccggaatggttcaatgccgataagcactggaccaagtaaacgccaactgggtgcgattctgtatacgatcttgttctgttgttttcttcttcctttattctccatttatgatggataaattggcgaaatggttccaatggagtaatggcgctgggctaggagtacctcggccgcgaccacgc

SEQ ID NO: 1017 - DNA, 267 bp, Trichoderma reesei
gcgtggtcgcggccgaggtccggaggctacatgcccccaaatatcccaatggatcctcagcaggccttggcctaccagagttatgttcagcgcaaccagggatacggctctggtatgcctcctcagcctggcatgccccccagctcccaccatcagtcatgagttgggccaattgaaaaaagacaaaacagcaaaccatacaaaaaaaaagcgaccatggaaagcaagccgaagtgtgaaaccgttaataaccgggctttcaacaat

SEQ ID NO: 1018 - DNA, 284 bp, Trichoderma reesei
gcgtggtcgcggccgaggtccgctggatcgcgaccagagcctgatgatgatgcccaaattcgacgagttcaatggtgtagccgtcggcatgctcaacgacaacggctacttcttctgatgggatagcgcatgcgtcagagtcttttgcgctggcgactcaattcgaatttgtcttatacctgccgaatcgactttacgatgacgccttaatatggaaccgggtctattgatcgggataatgtttctttcttttgtcatttttccttgggttataggacttctgt

SEQ ID NO: 1019 - DNA, 200 bp, Trichoderma reesei
gcgtggtcgcggccgaggtgagaaagatggcaatacccggaggaatattacttgctggaaggctaatggaatgatgaatgagctggacccggtcaactttgtgttggatttggatctgccctttcgagggactgtaatacgcaaaatatattaccagattactggcttaatgctaatgtcttcggacgcttttacgattt

SEQ ID NO: 1020 - DNA, 435 bp, Trichoderma reesei
gcgtggtcgcggccgaggtactgctgtgcggtggcattgccggcattgtgacctgggccagcgtgttccctctcgacgtcatcaaatcgcgcctccagacacagcaacagcagcattcctacaaggcaacaacgaatagggcgggcaacaggcggcatggagcgtggcagatggccaaggacatctatagagacggcgggattcgtccctttttcagaggcctaactgtctgcagcgtcagagcctttgttgtcaactccatacaatgggctgtgtatgagtggatcatgagcgaggtaataacgggcaatgaacgtcaaatgaatctgctttcagaggccgattcttagacaaggagatacgaaaccgagcatctgaagagcatatagcaaacagtcgtgaaaattatcgtacctgcccgggcggccgctcgaa

SEQ ID NO: 1021 - DNA, 369 bp, Trichoderma reesei
gcgtggtcgcggccgaggtcatgattcacggctgcatgatgaccagcaagacgatacgcattccgaagccctaaacctgcgactgaaccagtcgcaaattttcattcattttccaccactcggtgtcgctggatattcggctgtgacaaactgggctagagggtcaatggtctgtatggttcacgatcaatgaggaatggcgcatacgagattgctctatcatgttaggttgtgtagctggtcggcaagcgcctccaaatactgaagagtatcatggttgaagggcggtggttttatataatggatagctactctcctctacgcagggagaattgaccgttgaaggatgaggggatatagttttgcatg

SEQ ID NO: 1022 - DNA, 236 bp, Trichoderma reesei
gcgtggtcgcggccgaggtacgtaggggtccgggtctctcaacatgtgcttgacgaggggaacggtggttgccacgaactcgcgcacatgaatgtatgacatggttcgcaaagcgagcgctcgcacgagggggttcgagtcttgcatgtcttgttccaggatgggaatcgcattgaccgcaatctctgggcgaactcgcgcatagttgaccaagtacctgcccgggcggccgctcg

SEQ ID NO: 1023 - DNA, 317 bp, Trichoderma reesei
gcgtggtcgcggccgaggtacaggccaacaaggccctgctcggccacctgcaggccacccttgaggatgtgctccgtcttcttgatcttgccctcggccatccactgagagagctcctggcgggccttggggtagtccttgatgtggtcgaagacaatgaagccctgcatcttgatgcgcatggtgatgatcttggtgatgttgctggggccctggggcttggactgttgtacctgcccgggcgggcgcccgggcaggtaccttgttcccgtcacacctcgtttttcactcctctgatggatatcccgatcgctatg

SEQ ID NO: 1024 - DNA, 174 bp, Trichoderma reesei
tcgagcggccgcccgggcaggtactcggagcgctgtgatgtctcgtgcacagtcgaacagatgcgttatcatatgacccagtatatcaagtggttcgagccatccgaaggcggcgtattacaatcgattgatgtgatgaatcctcagaccttgcggcaggcgtgttttgatagg

SEQ ID NO: 1025 - DNA, 385 bp, Trichoderma reesei
cgggcaggtgttaatttatggtggaatatcaagttgaagaacggacatcatgtcttggatcaaccagctcattatagagtcgcgatgctggacaacgcgcatcatcatcttgggtttttgtgggacacttacggctatgcatttcggggaatcattcgggtcattatcgctcccatgccgtggacactgggaatgggcgagaaacatggctcggctataagagataaggacacagagacaaagggcaaacttctatgcgacgtgtgatgttgactgaaaaaaaaaaaaaaaaaaaaagcttgtacaaaaagtcttcccttggcctcgactcgtctcgctaccccatggtttcgtttggtgacacgtacctcggccgcgaccacgc

SEQ ID NO: 1026 - DNA, 361 bp, Trichoderma reesei
gcgtggtcgcggccgaggtaccgccactggtccgactcttactgaaagggctcaagaatcaactactcgcgcagtgggagggaccactcgcgaggggccgcagcatcgacccaatggtcatcacacgcgtccccttaatcagagacaggcagcattcaagaccagcttgtgcgctgcgggcagctctggggggtgtgacgcggtggggaagggatgatatagaagcaagagaatgtgcttgtatatacattaccacacaacaacattaatgtgtgtttgcaccagacagaagcaggtgttgcgcaggatcatgatgtaaattgcccgaactgtcgtggggtgggaataaaacatgtcggcg

SEQ ID NO: 1027 - DNA, 288 bp, Trichoderma reesei
gcgtggtcgcggccgaggtaccgacttgttctctagtgtagactctgggtcgagactcagaatgcgaactgtgcagtcgtcacaaccaacggcaaggaatgagcttcgcagtctgccttcagggacctcgcccaggctcaagcatgtaaccgttccaaacatctccttcttctcgtcatactcggcaagagaaccatcatcgtccatctcaaagtagacgatttcaccagagctcaaagcaatcgcgacttggtgagcgttggtggtcgcggccacgatagatcgatg

SEQ ID NO: 1028 - DNA, 263 bp, Trichoderma reesei
gcgtggtcgcggccgaggtacggccagtccaagacggccaacattctcttttccatcggcttggcaaataagtatggcgaccgcggcgtgctggcttacagcttgaatcccggagcgatcgcgacgacgaatcttgcgggacacttggactttgctcccgggggggatctcgactcgttgtcatttgtttttgccttcttgttctgcagcacgaatcactcggttgactgcgtcgccgttgggcacctgcccgggcggccgcc

SEQ ID NO: 1029 - DNA, 210 bp, Trichoderma reesei
gcgtggtcgcggccgaggtacacacatacgccccttccggtaaaactacgtctagtcctcctccagagtgctcaccttggcctctgcgctaggagcacccgagttgacctcgcgtcgggtgcggacggcagcggcaaggtcctcgaggaccgtgactgtgtcctcccagttgatgcatgcatccgtgatgctaacgccgcgcttgagacc

SEQ ID NO: 1030 - DNA, 502 bp, Trichoderma reesei
gcgtggtcgcggccgaggtactattgatgaaacggacctacgaaaggttttgcccattatcccgcgcgatcttgagcatttggcctcgaatgatctgcaaaagggctacgattcgatgaaggcgaacaagctggaagacggcgtcaagatcttccagggtatcctgcatgctatcttggtcaacgccgtctccagcgaaagcgaagtgtcggaagccaagaagctgcttgcttcagcaagggaatacaccattgcgatgcacattgagcttgccaggagaaaccttggctcggccgatgaggtcgcccaagaccccgcgaaactgaagaagagcttagaacttgctgcttacttcaccattcccaagattgaggtgcctcacaggcagattgcactgctaagcgctatcaaagtggcaattaagagcaagaactataattctgctttgggcttcccgaaccgcatcatcgcgaatggaggttcgagcaaaatcgtcgagaac

SEQ ID NO: 1031 - DNA, 232 bp, Trichoderma reesei
gcgtggtcgcggccgaggtactcgcgcaacatctgcccacttcaggcttcctagacaaagcccgtttcttcctgcatacaaagctcttacttatctacctcctcacatcgactaataacaaatctcatacacatgcctctcgaacctcttctcccacatcattacagagagatttagtccaacaactccatccgaacctcctcctccagacccgcccatctccctcctctga

SEQ ID NO: 1032 - DNA, 549 bp, Trichoderma reesei
gcgtggtcgcggccgaggtacaaaaaaacaaatgatatgacaatgcgccggtgatgactccctattttcccaattcttccgcgtcttagatacccatcgcgctgcttccctgcatggctaaacgaaaagggcaaactcaagcagcgcaaataaaagcacaaacaaaggggggggcaaacacatatgaaaaaaaaaaaaaacaaggcagggcagcatgaagatgctacctagaaacaaatctggttaggagacaatgcgcctttctcgcgcgtagatagctctgaactgtttgagtgctttcacgcacaagtcagtggatttcagaagtccacttgggcgccaatccaggtgccagtctcggaggacaaaggtctatgcaagcaaatacatccatgtagagtgctgccatgtgtaattgccaccagagattatccacaagagaaagcatgcgagagcgcaacagcgaccgctgctcataccacacgctgagaatgcttataaaataacacagcagcgccccctctcgtacctgcccgggcggcgctcgaa

SEQ ID NO: 1033 - DNA, 276 bp, Trichoderma reesei
cgagcggccgcccgggcaggtacgcgctccaggtcgcgggagtagaagtagccggcgaggccgacctcggagttgttggccagcgcaacgacctcggcctccgtcttgaaggggaagaggccggccacggggccaaacgtctcctcggaggcgagctgcatgtccgccgtcatgtcgcgcaggacggtgagctggaagaagttggagccaacgtcgggcagtctctggccgccgacgaggagcttagcggcctttcttgacggcgtcctggacgtg

SEQ ID NO: 1034 - DNA, 336 bp, Trichoderma reesei
cgagcggccgcccgggcaggtacatgacgtcgaataaccacgatgatttggcacagattgcgcagtggttgggagaagggaaggtaaagacgattattgatgcgacgtttgagtttgaggaggctgcgcaggcttttgtgcatctgaagaagggctcgagtagtggcaaggtgattgtccatgtttcgaagaagacgtaagatgcagtaaaggagcgtatgttgcgctgcattctgagaagacttcttctcaagaactggagaagataccctttatgaacctcaatgtaatataagcgggcatgtcttttttctctactttgtgtggcttctcgag

SEQ ID NO: 1035 - DNA, 404 bp, Trichoderma reesei
gcgtggtcgcggccgaggtacatacatacagcagcatcacatgggtaaggggggggccatcatcacagcaagggaccaagtcgttgcaaaagagaaagcgctcgcagcagcatgaccgacaggcatgaataaggccttggcaagccctcttctaacggatgtgatctgccgaggcaagcaaagaacgtatgtaaagcagcaaccgttatcgggcttgtcctgtttgcctcccttgccttgtcggtttcgtcatcgttgcgaggcgaagcattcccatggaccgcgaaagcaaagagaaaaagctgtcgggtccagttttcccagtgagacagcttgagacaatacggcacgaggaccctatcgattcaaaatattaacactcgcgctggagagacacaaaacaa

SEQ ID NO: 1036 - DNA, 373 bp, Trichoderma reesei
tcgagcggccgcccgggcaggtacttaggaaccaaatgataaacagccgtagcttatctgtagggtcgttgcccttgttctcgtccttgatgatttccagaatttgggcctttgtttgcttcatgacgttctcttccgtctggaagtagttgtccagctgccggtccttgatgcctgatagtagcgccgccaggatgttcatatgcatgtccaatatgctcttgcgctcccgcatctcaggcagcaatgttatggcggccttcacgtgctgcgcgctcgcactggtatcgttttgcaagtcttccaagctcgacacccccgtcgtcttcgtaatggcggccgtttcctccttgtacctcggccgcgaccacgc

SEQ ID NO: 1037 - DNA, 368 bp, Trichoderma reesei
gcgtggtcgcggccgaggtacttcagcaaatccatcaatcggctggtcttttatgcgtcgtttggcaatctcttgtcggatatcgccattattatgtctcgtgacttcatagacaacccagactcggccggttgccagattcaggcgttcatcattcaagtttttttgtcgtccgacgtattgtggacgttggctatggccatcaacgtccacctcaccctttactacaaatatgaagccagagacgtgcgcagattagaacccctctacttggtgtgctgctacggtattccgctgataccggggttcgcactgcttttcgcacagggccatcacggagttcggatcttcggtcctgctatcgctta

SEQ ID NO: 1038 - DNA, 289 bp, Trichoderma reesei
gcgtggtcgcggccgaggtacctgacatttgcgccagctgaggcgtggaacacacccaacattctgaaagcgaaaccgctagatgaagccccaagatctattcgtcgaacccatttgcagagctgccgcccaggcatcctgcgtttcttgagcgtgctcggtcgtgtggaagtcctcttcgaaatagggattgattctaacgcctacatgctcctcgaatatggtgacgagcgtgtcgtacctgcccgggcggccgctaagggcgaatttcttttttttggcccccccc

SEQ ID NO: 1039 - DNA, 341 bp, Trichoderma reesei
gcggccgcccgggcaggtacccaacaacggcgttgagcatcaggatccaagtagacgcgataatcatgccaatgtgaattgcgctgaaaactactcgcacagtctttccgagggggatttcgccgaccgaaaagatctcgcagatgctgactaggatatagctgagtaggaatagttgaatctcacaacggccgacggcggcctttttcttgtccgacttgataatgaggaacgacgccatggcaatcccgaggccacaaagaatgatcgatccaagattacccagatgtcggccgccgctgagcgggattcccgtgagcgtacctcggccgcgaccacgc

SEQ ID NO: 1040 - DNA, 262 bp, Trichoderma reesei
cgagcggccgcccgggcaggtacagattggatgcgaggtcagcgatatccaggcttgagaccttgaatagatatgcgctccaagctgggaaaccggacaccgcccaagctatgccgcgaatcaagccgagccgcccaaccacaacatatttgaacaagacgggaaaggaaaaattagcatctatgccgtgctgaaccgtaaaccgacaacgtcaacctatccatttttgttgcactggtcgtagccagtgaggcccgcactt

SEQ ID NO: 1041 - DNA, 353 bp, Trichoderma reesei
tcgagcggccgcccgggcaggtactcctttggtgtcaccatcgtaatcgccattgtctacttcatcctcaaccagatccctgcgctcaacgaccttggccgcaaggaccgcaagaagaaggacaccattgtcgagaacgtcatcactgctctccagaagctcgccattgagcacgagagagacgatgtcaagggcgtggaccgatacctcctctctgacaaggttgattgacgaggatgaggagtaaattgggatttttccttcccagtttccccatttctactagagagtgtaatgtcgcggatgtatatacggcctcgagttgggtaaaggtttctacgacttgatttgac

SEQ ID NO: 1042 - DNA, 78 bp, Trichoderma reesei
gcgtggtcgcggccgaggtgggacttgggggcgatctcactgcgggaaggaggggtgtgtctggggtatttgaacgga

SEQ ID NO: 1043 - DNA, 337 bp, Trichoderma reesei
ccgtggtcgcggccgaggtgttgtacatggccccaacgcgtccacggtatgcagggtggttaatctcaaccacgtacatggggcccgctgccgctgcaatggagacgccgaatccaagcagaaagcggccgcccatgaactggccctgcgagtttgacagaccctggatgatggtgccgacgacaatgaggatggcacccaacagcatgccgattcggcggccaaagccgtcaatggcagggccgaccaaagggaagggcgacgacaccaccaatctggtacatggaagacacaatgccggcccagatgcacgtcgtctgtcccacagtgtacttgg

SEQ ID NO: 1044 - DNA, 318 bp, Trichoderma reesei
ttcgagcggccgcccgggcaggtacttgcatgcgcctgaccgaaccgtcccctttgaggagacggcagaggccattgacaaggcataccgagagggaaagtttaagcgctttgggctgtccaactacacggctgaggaagttgagcagtttatcaagattagcgaggagcgaggctttgtgaagccgactgtgtatcaggggcagtataacccgattgtgaggacgggcgaaaaggagctatttccggtgctgcgacagcatggcatttctttttacgcctggagtcctggagctgccggcttcttcagcggaaacca

SEQ ID NO: 1045 - DNA, 438 bp, Trichoderma reesei
cgagcggccgcccgggcaggtctatccaacaccctcgcctcatcgtgagcaaaaagctatctgccgacaacaaccgccaccaccaccaccaccagctacagaaatccagcactcaatctttctcttcacgcggtcgcttcgccatactatctcaatacacggaaccgcattcaccctccagcaaccacattactatcagttcacaaaaatgaatcccgtaaccagaaacttctcaaccgccgcaagagtgcacccctccattttggcacaccttcacgccttgccggggcgagaacttgggcgggaacacgctaaaggggaattccagcacactggcgggccggtactagtgggatcccgagctcgggacccagcttgattgcatagctttgagtatttctatagtggcaccctaaataagcttgggcgtaaatcatg

SEQ ID NO: 1046 - DNA, 185 bp, Trichoderma reesei
gcgtggtcgcggccgcggtgtcgaagggcgaagtgaagaagggatatcgaggtggttcgaagtagtcaagcaagtcactgccagtcgaccaaggcaagtgtccgaaattgtgtgaaaattggtctcgcgagctagtgacggaagaggagaagagaatggtatggggaatatcggagaatgagaac

SEQ ID NO: 1047 - DNA, 98 bp, Trichoderma reesei
gcgtggtcgcggccgaggtactctcagatgcagatcagctcgaacgctcaggaagccatctcattcatcccgatcctttctagcacggtgaaagcagc

SEQ ID NO: 1048 - DNA, 464 bp, Trichoderma reesei
cgagcggccgcccgggcaggtacctcaatcgaccggcgggtcgttctcctgcacgacggttccgcaatcgttctagaaagagcagacatccccttgtttagccttgtttctttttgtcgtcgtcttcttgttttctcgccttctcttcaacggaaaggtcaccaaccccagtaattatctcggctgtgacatcttccaccacccgagtttcgtcgccggatgcctcagcgtcttcttcgtcgacttcatcttcgtaattctccctccccatcggcgaatatcgtgctcgatgctcttcgagagatctcctcctccctctctcttcggtcgtcgatcgtattcccttcgtgcggagatgagagatatctccccatgcgcctccgccgaaccctcggggagcggaacacgcctaaaggggggaaattttccagcaacacctgggggggccggttaactaattggga

SEQ ID NO: 1049 - DNA, 387 bp, Trichoderma reesei
cgagcggccgcccgggcaggtacaccggatggcacagtattcgttgtgccgactacgcacgacatggtttcgcagctccttgacccgcgacagccaaagaacctttcggacgctgttgtgctagctatcctagcattgcacattttagcagcatatgtcttgccggctgggtacaagcgacctgtgttcgcggccctcttcctcttttggagagcgtcttacaatgttggcattggatacctgctgcacgtacagtctcaccaccggcgcctcattacctgggccaagcgatggaaacttttcgagaatccgagcactgggaacaatcctcgcccatggttgtacaagctgctcaagccgggagctcgaggccaaagattccccagg

SEQ ID NO: 1050 - DNA, 346 bp, Trichoderma reesei
tcgagcggccgcccgggcaggtacgggcaataaacaagagattgaaagatgcgaaagagcggacaactggatgagcctggctcggttcagatttgtggaagaagcgggttatttgagatgagtgtgaacttttccgcagtcacggctggacgatgttgaaattgtatgtttgggtgggctgtgcggtctattattccccgagttttctgttcctttctgatgaatgatgacacaccatctgttttcatttggcttgcatcgttgggaggaggtttgcttgtaatagcggtcagtaagagaattgaagcgggacggagatggcccggcacgggatcggctaaggggt

SEQ ID NO: 1051 - DNA, 150 bp, Trichoderma reesei
gcgtggtcgcggccgaggtacttaatcagagcaggccatcgcgttaatggcatggattccgggacaagaactgcgctttactacgctgcaaagaagcgcatgcttcccattatggacctgcttctcgagaatggtgcggatcccaatatt

SEQ ID NO: 1052 - DNA, 223 bp, Trichoderma reesei
gcgtggtcgcggccgaggtacggagttatttttgccagcccccgggctgacagcggcacttcggatctggccctcgaggtcgagcgcgaaatcgcctcgtttgttggaaaggccgacgccatggtcttctccatgggctacgtcaccaatgccagcacgttccctgcgcttgtgtccaagggctggctgatcatctccgacgagctcaaccacgcctccattc

SEQ ID NO: 1053 - DNA, 262 bp, Trichoderma reesei
gcgtggtcgcggccgaggtgatggacaaggggaatgcagaacacgggtctcaacggccaaagagaagctcgatacccggcatccgtggcgtttgggtagtcttcgcattaccttggaagaagacgggcagggtgggacagagcgatactcctacataatacgaagatgaccttggaaggccgaagggacccgagggaggacacgaagcgcaccgatatgctgccatgtaacactaggaatgtacctgcccgggcggcccgcc

SEQ ID NO: 1054 - DNA, 369 bp, Trichoderma reesei
gcgtggtcgcggccgaggtacgactttgtgccaagaccggcgtctttgcctcggaccagctaccatcacccccggacgcagcccccgagacatgctactgcaaagtcaagctcttcagggatcatggagccgagcgaaagctctccaacgatgttgcccacgtgaagaagtcgatcgacaagctcaagcagcaaattgcacaagtcgagagcgggctaaaggatttcaaacgaaagaggtcgagtggaataagcaaggcagggctgcccggcaagcaaaagcacaagagaacctggtcaatgtcctcgaccagctctgctggtggtacctgcccgggcggccgctcgaaagggcgaattccagcacact

SEQ ID NO: 1055 - DNA, 333 bp, Trichoderma reesei
gcgtggtcgcggccgaggtacccagtatattagtgacaagcaccttacccggcgagccctcaatatcactttgggccgtcacaaggccgctttgtcacaaccggcgtaaagtgacctcatgggtcttatgacggcaagcgtttgctacgcaagcatgtaggcgaacaccaaaatagacaccgtccacaatcacgtccagtagtcttagtggacgcgcgatcatcgcatcgatgggagatatttgatcttgaatatctgctgcgccttgagaaaaaggtttcagagtcaccgacaaatcccccaataacctcaagttgcgttcttctgccgtgg

SEQ ID NO: 1056 - DNA, 147 bp, Trichoderma reesei
gctcatactcggagatgctcctgccctcgtcttgatcttcatccaagtaggcctcatccttctcgagccggatgaacttgccaaaggggtagaacaagtagccggccaggccccaaaggattcttccggagctggtttccgccgaag

SEQ ID NO: 1057 - DNA, 69 bp, Trichoderma reesei
gcgtggtcgcggccgaggtacggccagtgtggtggcagcggttacagcgggcctactcgatgcgcgccg

SEQ ID NO: 1058 - DNA, 92 bp, Trichoderma reesei
tcgagcggcgcccgggcaggtacactaagaaaaagaaagctgaagctgtattactgtgtaagtaacggattaatcatccattaattacatca

SEQ ID NO: 1059 - DNA, 196 bp, Trichoderma reesei
tgagcggccgcccgggcaggtaccttatggttgggataagatggcacggccagggctttctgtacgcttcatgtatctgtatgtaagacggcgggatgacgttggccttgctgggcgagacaagacttgattacacagctatgttattgacttgttattgacctggatgctttgggtacctcggccgcgaccacgc

SEQ ID NO: 1060 - DNA, 100 bp, Trichoderma reesei
cgacccattacctcttcgcactcggcagctaccgcgccctctacattccgaactggatctaccgctaccttgccgatcccaagtataaggttgactggat

SEQ ID NO: 1061 - DNA, 340 bp, Trichoderma reesei
cgagcggccgcccgggcaggtactctctgcaggaacttggttgctgctgtagccattgtgaacgagactgtatgaggattgctagcggttgaaggattgcttccgcagctcgtgaatttttttatttttgatttttcctgcttgtcctcaggaggtgcgcctcagccaatgaaggacaagggaacaccggactctggaaagggagaggaggacgacgacggttctgcgagaggatcgaagtcggtcagaggagggatggaaattcaagaaagatcagagctggccagaagacaatgcaaaatgcagagagaaaagaagaatacctcggccgcgaccacgc

SEQ ID NO: 1062 - DNA, 53 bp, Trichoderma reesei
tcgagcggccgcccgggcaggttcgtgccttcacggaagcaggagagcacgac

SEQ ID NO: 1063 - DNA, 303 bp, Trichoderma reesei
gcgtggtcgcggccgaggtacctagacggtcaatatagcttctaaaatgttagtacatccagtcgacctgtgccacatccggagatggtctctacgaaggtctcgaatggctcgccaccactctccgaaagctggcccccgtaaacaattaaaacccaccagaacctcgactggtagagctttccgctctacatcccgctttcctaccgcacactcccgcaaacttgttgccgagctcgagaattcggttgtaattgcaaggtatatcgatcataccaatcaattttatccataaactctgtc

SEQ ID NO: 1064 - DNA, 76 bp, Trichoderma reesei
gcgtggtcgcgggccgaggtactcggcgcttatggatacccacgaccgactgatggggcctcggaccttcctcacg

SEQ ID NO: 1065 - DNA, 362 bp, Trichoderma reesei
gcgtggtcgcggccgaggtacatggccaccctcggtgtcgaggtccacccccttggcttcaccaccaactacggtcagatccagttcgacgtgtgggataccgccggtcaggagaagttcggtggtcttcgtgacggttactacatcaacggccagtgcggtatcatcatgtttgatgtgacatctcgcatcacttacaagaacgttcccaactggcatcgtgatctcgtccgcgtgtgcgagaacattcccatcgtcctctgcggtaacaaggtcgacgtcaaggagcgaaaggtcaaggccaagactattaccttccaccggaagaagaaccttcagtacctgcccgggcggccgctcga

SEQ ID NO: 1066 - DNA, 563 bp, Trichoderma reesei
tcgagcggccgcccgggcaggtacaagcttttttttttttttttttttttttttttttcgcccatgaatctatcaaattgatcgcttcactacccaaatcctcatgaggtattaaccccgtaaagtctgctggtcttgtatgccacctccccctcttgatatcgagcgatgaaaggaattcagcctgttccgcacaccctcttcctttgacaagcagcgcgccatgcccaggaattgataacgcagctcatctagcgaactgcttctcgacctcagctgacctctctggtaggcataccgtcgcgtagcgatacacactactcgcgtgaaatgttgccctccatgtcgcttcatcacaaatccaatagcgtcttcatccccatgttttccgcttctgttccctccaatgccagtctttatcggggacaggaaatgatagcgcctcactactaaaaggcggattcacacgaatcgccggcaaatcgcccggtctttcaactggggtgctccgcaccatcgcgcaaagatgccatagcaaacccgtacctcggccgcgaccacgc

SEQ ID NO: 1067 - DNA, 222 bp, Trichoderma reesei
cccgggcaggtacgtctggccgaagacgggggcgaggacgacgaggtcgacgccgtggttgaagaaggtgccgagggcgatggccgagggcttaaccgcggggaagtattgaagagacattgtgatggatgctgtttgatgtgatgcgatgcgatggagaggttggcgagattgatgaaggagtcaagatatcgtcgttcagtacctcggccgcgaccacgc

SEQ ID NO: 1068 - DNA, 194 bp, Trichoderma reesei
gcgtggtcgcggccgaggtacgaaggctcatttatccgcatcttccgccgtctcgaggagctcatccgacagatggcccaggccgccaaggtcatgggcaatgacgacctcatgaagaagtttgaagagtctctgcagaagattcggagagacattgtggccgcccagagcttgtacctgcccgggcggccgcc

SEQ ID NO: 1069 - DNA, 266 bp, Trichoderma reesei
gcgtggtcgcggccgaggtatcaagcaagccgaaagcaagaagcgagactttgaagaagagagcaaggactattatgcttatgtttcgcgatacctcggccagcgtcaagattcggtcaaggctaagaagcttgccgaaagcgattccaagtatcagaacaagcggcgaaacttcgagctcaagcgcttcgactactcaagctttgtgcaggacctgcacggcggtcgcaaagatcaagaggtacctgcccgggcggccgctcgaa

SEQ ID NO: 1070 - DNA, 473 bp, Trichoderma reesei
gcgtggtcgcggccgaggtacttggttgatcagatcctgaaactcggcatattggtcgcctcgcagctcgtccagtccgggaaaatcatcccatgcgcttcgtgaggaccagggaatggatggaacgaagcgtccaagctttgaggcgatgtccccaaagcccgggaaacttggcacgggaaccgaaggaacggaaaccgaaggcgcgtcttcgaagctgggcaaattggcgatggcaatgctggataatacgacggcgagcagaacgaatgaaaagccactgatagtgtaaaacagaacctcaccgatgcgtagcaaccggtcccggaagggatccgtgaaaagacccgagaagaggttgacgacactttccagggcggcactaaagaaccaagagatagcccgtaagtatgtgagcgggttgaagagttgttgccagttgatggagtcatcggtgagtgccgagtcgagct

SEQ ID NO: 1071 - DNA, 576 bp, Trichoderma reesei
tcgagcggccgcccgggcaggtactttggataccgccacttgacggcatgttgaaacagagggcctgactgagcctttgtctctccaggacagttcaatagagagcatgaggcaaggtgggaacgatgattgaacagagcttggtgattgtgcggtctttgagctctgccggtcctggactctcattggaagggacaagacgaggatggtattgcatgacgatatctttcctgtgttagtcatgtcatgttactgattcaaaggaacggccatggacgtgatggcccgtcgagctggtctgttgctgggttatctttggtggtgatccagttgaaagcacaaagagcattgaaccgcctgaagctatggcttgatccggcatgcaggtgaggctcaagacaacactgaaaagagatatgaaaggcgacaagacatgcacgtagctattgcagatcgctgcctaggggctttgcctgttcatgatgcaagaacttggttctttgtggatgaatcactgatgtgaacagaacaggtgaagttgtgcttgagacctcggccgcgacacgctaaggcgaa

SEQ ID NO: 1072 - DNA, 230 bp, Trichoderma reesei
tcgagcggccgcccgggcaggacagcgtcgtttccgtgtattggaaaccccttgtatacataaatcatgcccgagtccaatcaattccctcccagcttggcaacgaaccaagaataatgcggatggagcgtccaataatggcatcggcatacaaagcagccatatctatgtctgataaagctccatccgatcaatgtcttgtagtgtcggcacctcggccgcgaccacgc

SEQ ID NO: 1073 - DNA, 420 bp, Trichoderma reesei
gcgtggtcgcggccgaggtacagatttagagtagccctttccttcttttaccctcagcgggcctatgaggtgagatgtagtccattaggttattagagtatcgagtttggcagtgccgattctgctgccgtcatccaatatgcgtttcgtcgtgtttatccatcataattgcgatggagaatgtaattatcgatcctcccacggaagagtgttttcgtgtttatgtgtgagggtgggaggacagtgtatgtgagagataataaggagagagtgtgagattgtgcgtttctgcagagtatccgcgcacgccttgaccaagattaaccgatggtcatcttagagcccgttcactgagccttttcggcttgcttctgttggcccagacggttggtgcggtttccgttgtacttttgtacaagc

SEQ ID NO: 1074 - DNA, 190 bp, Trichoderma reesei
gcgtggtcgcggccgaggtactattaggttccatgtctctcctcatgacgatcatccctcgccaaacaaccgctccgaaactgccgctcaaacagccctcgccctccatcgcctttgaagctgtcatcgattccgttcacatcttgacaggcatcattgacatcccacccctcgtcatttcttcataatc

SEQ ID NO: 1075 - DNA, 316 bp, Trichoderma reesei
tcgagcggccgcccgggcaggtacctatctcagttcggccccatctcacggctgcgcctctcccgcaacaagaagacgggcgccagcaagcactttgcctttgtcgagtttaccgaggccagcactgctgagattgtctccaagaccatggacaactacctgcttttcggacacatcctgaagtgcaaggttctctccaaggagcaggtccacgaggacctgttcaagggcgccaacagaaggttcaagaaggtgccgtggaacaagatggcgggcatccagctggagaagccccgtacctcggccgcgaccacgc

SEQ ID NO: 1076 - DNA, 465 bp, Trichoderma reesei
gcgtggtcgcggccgaggtatggtttccacccctatcggtttcaggatacctcggcatctttatcatcaccgaaacgccatatactataagggggtggtggaattaggcaaacgatattgtgctcgacactattttgtctcgtcatctctcaatggtcgaggaagccgctcaagggggagtccacttacttgtgtgcgatgaatatttgtgagcctgcccatatctcactcgtctcgtttcggtatcactgtttgatgccaaggaggcgtgggcatcacagagggggtagagacgggtaacatgagagtgctgctcgcatcacgatgcgctggatctgacgagacggattcctccgccgcatatgcctgctgatcggaggaatacgaggttgagacgggcttctttggccactattttactgtttttttaatgtttttcatgtacctgcccgggcggccgctcga

SEQ ID NO: 1077 - DNA, 287 bp, Trichoderma reesei
gcgtggtcgcggccgaggtaccggaactgcagcttgttcaggccttcgatgaacgcagagaaggggatcttatcccaagtctgtccgttgctaacgtgttccaggaggcgggcgatgttgaggagctgggaggcggtcttctcgtggaagtagtccttgtcgctaccaagccgggtcatctcgttcttgatttcctcgttgggagcgaacgcagcgagagtggacacgaactgacgggagacgggagcaccgatttccaaatggtacctgcccgggcggccgctcga

SEQ ID NO: 1078 - DNA, 49 bp, Trichoderma reesei
gcgtggtcgcggccgaggtctcgcacaaaaagaaagatcttctacccac

SEQ ID NO: 1079 - DNA, 388 bp, Trichoderma reesei
gcgtggtcgcggccgaggtactacgcaatcactgtcgcttctagactttcaattgcttcttccctctaatctacctcacaaacacaaaaattgtctgccatgaaggtcatcctcgccatcaacgccggctccagctccgtcaagatatccgtctatctggccgacaagaggacggcgccgcgccagattgccgagtctcaagtgagcggcctcacagctccgccagctaagctgaaatactcgcggggtggtgagaccgttatcaaagagcaaaatgtggacaatgccgtcaacagccaggacgatgcctttgccttgctgctcaagacactggaagatgatgctcagttgaaagagatcggctccaagtcagacgtggccattgcat

SEQ ID NO: 1080 - DNA, 287 bp, Trichoderma reesei
tcgagcggccgcccgggcaggtacgagacccagcacatgtccatcttttcaacactgctggccagcgttgttcctactcttcacatctacgacggcattcgccttcctagggagactctgcgagtggttgacgctttgagcgagactggcgtggccaacgtgtataacaccctcgtcaaggaggctggcaagttgaaccagcacctggatactgcaggcaaagtcctggagcttctgaaactctttaacgatgagctcggcactgtgtacctcggccgcgaccacgc

SEQ ID NO: 1081 - DNA, 260 bp, Trichoderma reesei
tcgagcggccgcccgggcaggtacaagcttttcacgccatgatatcttttccccccttctatacccgcagacccagctcctcagcataaggcagcacaaacaggtcaccaacggtagagacggttgcctttccgtcgaggagagacttggcggtagtcttcagcttatcggcagtgacggcgtccagagacttggccagggcagcgaggtcctggaccttgccgctgtggacgagggaggcacctcggccgcgaccacgc

SEQ ID NO: 1082 - DNA, 224 bp, Trichoderma reesei
gcgtggtcgcggccgaggtccgcgttccttggacgatcgacaacgacgatcagggggaccatagttgcacgaagacattggcaaggtggaccgccctcaaggctcgcctaatgccatctttatacatgcatgcgaagggagggtcgctagccaggaaggggagtattataagtctatcaaggccatggcgatgcaatatgggacctgcccgggcggccgctcga

SEQ ID NO: 1083 - DNA, 178 bp, Trichoderma reesei
tcgagcggccgcccgggcaggtacttgcgaaccatatagtagacaggcaaggcgacttgatctggcagagactggaggcaaaggagagatgggatctatagaaaggggtgagaatgcccgatactgtcagcgttggtcggcttagcagttgatgttggtacctcggccgcgaccacgc

SEQ ID NO: 1084 - DNA, 399 bp, Trichoderma reesei
gcgtggtcgcggccgaggtactcgatcctatatccagcctcccacgcttcatggtaatatccgtgtctccttcatattgcctggtagagtaactgggtagtcttggatttaactcagcggcctttgggaactcgcgacctgcctgcctcgaccctgctctaacggctgcctgttctcgtcccaagaaaacagcgaaccaaacgggaaatgctgtatgacaggaaatttcgacaagacttcggcattatacatcttgatcatgcctttgttgattttgccccatccgtctttaataccagagatgtcaaatagcattgggctgtgctcccaaaagggaccccttttcacgtcattgatgaacgcaacagccgaaaagtacctgcccgggcggccgctcga

SEQ ID NO: 1085 - DNA, 273 bp, Trichoderma reesei
tcgagcggccgcccgggcaggttagggggccgcctctgctgcgatatttcaacattgtggcaaatatgaatatccctttcatttgtcggcaagggtgtgttttggttttgatttgttcacggtgttggaggctatcttaatactttgggatgtcttgaagaatggtctaggtgggctgaggcgccgggcaaggctggtaggatcatgagcgactttatggttatgacgaaaaagatatccccttgattatgtgtacctcggccgcgaccacgc

SEQ ID NO: 1086 - DNA, 376 bp, Trichoderma reesei
gcgtggtcgcggccgaggtccgcgacgagcacggtgacgtcgtcgcagagcgcgccgactcgctttgtctttctcggggactacgtcgatagaggatactttagcttggaggcgtttacattgctcatgtgcttgaaggcaaagtatgtccttgctgttgttcccttggaatactcccttgcctcggcactgctgaagatgggattctgcgccttgaacgaaaacaaagaaatcctgctctcgtcccgtatgttcttctttgattcaacacagcatactgacaccattatagatacccagatcgcattgttcttgtcagagggaaccacgagtcccgccaaatcacacaggtgtacctgcccgggcggccgctcga

SEQ ID NO: 1087 - DNA, 264 bp, Trichoderma reesei
gcgtggtcgcggccgaggtacaagctttttttttttttttttttttttttttcggacgtaaacttcagtggtattgttgcaatatatgtgaaattacagtaaccgaccgctcgcaaagaacttttctgctcttccccatcattcgcccctttacaggtgctcctcgaaccaagtcacagcctgcaaaaaggcctgctccttggcaaacttctccgccttgaccttgacgtcgcagcgcaccgacctgcccgggcggccgctcga

SEQ ID NO: 1088 - DNA, 120 bp, Trichoderma reesei
gcgtggtcgcggccgaggtacaaggtctctggtagcagtctgaaggtgactgttgagccgagagcgatgaagactttttggttggagtaagaactcgtacctgcccgggcggccgctcga

SEQ ID NO: 1089 - DNA, 492 bp, Trichoderma reesei
tcgagcggccgcccgggcaggtacattaagcaacatttcagccacccacaagtgacccagtctgtggcaataaataataaaaaacaaattatctactgacagtcttgtattactattagatattgaataataataatatgttaactgttttcactcgtgtcgccaaagagaaaatattttctcttaaagatccccgtcgagatcttagatattaataaattgaaactttacctaataaatagttaattaattatggctctattaattaattacttctttctattaatatcacgactattatatatatatattgaggttattacctcggttaaaagaacttatacttgttcattctttaagcctaatttatatttcatactaggaagtatataaggtagtaatatatctcttaatttgggtatagattcttttgtaatgtatatagaatatcttccctcaatatttttaactgtacctcggccgcgaccacgc

SEQ ID NO: 1090 - DNA, 178 bp, Trichoderma reesei
gcgtggtcgcggccgaggtaaaaaaatgatccagaagctttccaacctccttgtcaccgcactggcggtggctactggcgttgtcggacatggacatattaatgacattgtcatcaacggggtgtggtatcaggcctatgatcctacaacgtttccatacgagtcaaacccccccata

SEQ ID NO: 1091 - DNA, 331 bp, Trichoderma reesei
tcgagcggccgcccgggcaggtgtatgtgtgtgtgtgtgtgtgtgtgtgtgttttatcgtccgctcggattcgtggtttgcgagctgaagagctgtttgtgtgtgtggttggaggtggaagggaggacgagtgtgatgacgtcggaagaggctcggtgttgtttaggtcgtctggcgtttcttctcgtcgtccttgtagtgatatattagccttcgtgctcgtcttggtcaaagtattcgtccgcagtcggtattcgatgcacgtcgtgaaagaagacaaaagcgtaaaccagagggaagattttatcgttcacctcggccgcgaccacgc

SEQ ID NO: 1092 - DNA, 270 bp, Trichoderma reesei
gcgtggtcgcggccgaggtactctagtatatacaaaaaggggcaaaaggaactcatgaatgcagtgaaagaaaaaaaccctagcgcatcaagggcagccaaatctctcgtctttgcaagcaaaagaagcttcccagtctatcagagcttgcagaaaaagccccccttaaccctctctatatatataatgaaagagacatggaagaagattcgtcaagttttgtcgtctgggaccaagcgcatcatgatcgtttatacaccagtgaattag

SEQ ID NO: 1093 - DNA, 339 bp, Trichoderma reesei
tcgagcggccgcccgggcaggtacgaagacccggggatagcattcgtctgggtttgatgtgtgacatattaaatctgactcgtctgatgccgcttggggagagtgttgtgatgatgatgacgatgccgttgctggggctgctaagcagagcaataggcccaagatgagggcaaatatgagtgccagaggcctcatctttgagtgaacggaaggcattgctttttgtagtagaaatttgaagtagagaaggatggttcaaaggtgcgtttgctgagagttggtatccaagatccgcacttcgtggtgttatataaaaaggtacctcggccgcgaccacgc

SEQ ID NO: 1094 - DNA, 367 bp, Trichoderma reesei
tcgaacggccgcccgggcaggtacttgagcgacgcctttctttagcagctagtggcaatcggaaacctgccgtctttgttttcacacgttcggccccaagtccgatctgccaacgggagcgatggaggaaggataatttttcattgtcgggcgcatcccctgcatggattcatccttcttgagccgactactacaggctgcgaaacaaacttgcgcgaggagtttgtctgacttccgtttacttcactcgagttgaatcttggcttgcttttccctttatgttttggttgagaaggaaatcaatgatacctcggacgaagaatggcgtagcagacggaggcgctccgtcctctttgacttcctttcg

SEQ ID NO: 1095 - DNA, 75 bp, Trichoderma reesei
gcgtggtcgcggccgaggtacgaggaggaagagcttgtccaggaggtcaaggagagcgacgtggtcgacctgttc

SEQ ID NO: 1096 - DNA, 185 bp, Trichoderma reesei
gatgaactccaattatatcattgtgcttcattttgccttgatctccaagacgccaaagtatgtaatacgcagcaaatctacctgtatcttatcctctattgcacaccatcatgtatcatgtcctctttcacatccttgggctacctctttctgttgctttttctccccttcttgttctttctttg

SEQ ID NO: 1097 - DNA, 207 bp, Trichoderma reesei
tctagcggcggcccgggcaggtgggatatcatcaggtcgcaccatcaggtcatgttcatcatcggtatttgcttgaacccgaaaatcccggccccgaaattgactcgcaaaggcgacatgggggcctattaggagtcggttgggttggaagctggcgtcatcagctaagcgttgtgtggaggccgttgggatctttggtgtcaatgg

SEQ ID NO: 1098 - DNA, 337 bp, Trichoderma reesei
gcgtggtcgcggccgaggtaccgtgggggctatattcggtggaatcttgaacggctatatggtatctcgattcggttaccggcgcgtctttgatgggagcgttgttcttcatgaacgctttcatctttattgtattctttgccaactctgctgccgtgctactcgttggtcagattctctgcggtcttcctggggagtctttgcagttacgagtccatcctacgcttccgaagtctgtccaacgaacctccgaggatatctcacgacctacgtcaacctttgttgggccatcggccaattcattgccgcaggtgtacttgcccgggcggccgctcga

SEQ ID NO: 1099 - DNA, 364 bp, Trichoderma reesei
gcgtggtcgcggccgaggtactcgaactaccagccgcattctccctatgctcaacccagccagcagaacctctacagccagtcagcaaacggcgcaccgccccctagccactaatggaccgaagcgacttcgtgatgccccgtggcaagctacctgcctatagatgggaacatcattggaccttgttggtcgcaactgcccactcctcttgacgcgttggacataatggttttccttttgtcttttccacacggcaggaaaacggggtctcgagtggaaaacattcggtctctggaggaaataatatttcattgggatgtcgcccggattggagcgcgccgtacctgcccgggcggccgctcga

SEQ ID NO: 1100 - DNA, 238 bp, Trichoderma reesei
tcgagcggccgcccgggcaggtaccgtgatggctttgtgacggatgagaaacgttcactattcttctcgcggccgggagacatataaggcgtttttcgaggcttcaagtcggccaaggcaggaggcaggccgagaggtggcagtgtggtagatcgaatctgacggacgggaactatacgaaggatctcgatcgaaccgtggtgtgactcttttcgtggtacctcggccgcgaccacgc

SEQ ID NO: 1101 - DNA, 264 bp, Trichoderma reesei
gcgtggtcgcggccgaggtactctctctgcaaggatatccaaaagattcagaggcatcccaagggcatgggcaaagaattccttgccgcccctctgctggtcatgaacggcttctctcgccccggcgccaccgccaagtccaaggtccccaagcaccttgaatcactagccaccaccgtcttctcatctatgtttcccccaatcaacccccagaccacaccaattaagacgattcgcagagtacctgcccgggcggccgctcga

SEQ ID NO: 1102 - DNA, 370 bp, Trichoderma reesei
tcgagcggccgcccgggcaggtcgattctcctttgttgctcgcagcaacaggcaagagcggggagttgtattagtccatgttgtctttccttcgtccttcatgtctggtgcttttctggttcttgtcagtattatctcttggagtttggccacacacgacggggtttgtctttgtttcgcttggcgctcacaagggcatatgggaaggttgggcttttgcctttctatgttgttttcctggtttgggtgtctctgtttcctttatactgcgcgctggattcgggtcatgacaggtctcgcgatggagtcactctaccactacggtcatctcctgtgtacatctctcacgggttccttcttgtcacgctct

SEQ ID NO: 1103 - DNA, 470 bp, Trichoderma reesei
gcgtggtcgcggccgaggtcctgtgatgacttgactttctgcccgccgttcctcttgtcaattaacacctttgtcggcatgatccattgtggtatttccattcttgtttctcaaagtctatggtttacgggttgccacttggcaattgccgtttagtagttatgtttgtggaacatattggttttcctttctcttcttcattctccttgtcgatagggcacaaggacttatgatgattttgaggttccttcttgttgaatcttgcgcacgatgattccggcttccatatgttgcagatggcggacgcagatgtagaaaaggaacatcaaagaaagaaagaaaagaaatagggaaatttgaggaaaagggaaaggaaaaggtaaaatgttgaacagaaaaaaagcgtatagccttgataggtggctcaagcgcttttctctttttctttcaatactcgctcatcacatatt

SEQ ID NO: 1104 - DNA, 281 bp, Trichoderma reesei
tcgagcggccgcccgggcaggtactggtagacctggtagactaagagatcgtctttggccggagctgcatactgaagcctatcgcccagaggcaaaccgccatagaaaaagaattcgtcatcgttggcgaggagggcgccgtcgacgtagtttggtgagtcgccgttggtctgcccaagccctcccaatgcttttgataacttatcttgcagcaagagacccgtaacgttcgtctcaggggtgaatgcgtaactcaaattgtacctcggccgcgaccacgc

SEQ ID NO: 1105 - DNA, 411 bp, Trichoderma reesei
tcgagcggccgcccgggcaggtacgacgccatgagccgacctgcttcggctattgctgctccccgtcggcggtagagaagactacacaacacgtaattccaacccttttcttttcccgccttgacgagttcaatgtttccactgagttccatgttctcgaggtattgcagcatctttcaggtcatccaaccacggtggggagggggcagcggcggcgtcatgaaataatctttatctgcagcgattttgtggcaccatttcctcttccttttttcttttcttttctttttctttcgttttggttgttgcttcatctgccgccattttcccaacgatgtaacgacattccttgccgtgtatcttggtctcgtttcccccccctttctctcttcttttgggttccatgcaccc

SEQ ID NO: 1106 - DNA, 234 bp, Trichoderma reesei
tcgagcggccgcccgggcaggtactcgtaagtataggcggagctgaggaaaaaggcgtcttcgccgggcgtctcctggccacggccccagagggggcttcggaagccattgacgtttggcgcatagacgtcgagaccgtaacggccgctgttgctgaatgctcgagcttgggtcgagatgatgtcggcaatctggtggatcaatgtgcggttgagacctcggccgcgaccacgc

SEQ ID NO: 1107 - DNA, 303 bp, Trichoderma reesei
tcgagcggccgcccgggcaggtacataatcaccgccattaagccgttccagggcagttcgacaatgatttgagacagcatgaataccttccacgagtagaccttggaaggacgctcgcgcacttcatacagagaccgctggatgacgaactggggcatggactgctggacgagctggccaaagatggtgaagagctggaagatggcaaacatctggttctggagaccttgctgggtgtttggcgccttgtagaagatgaaaccgatgaagagagcaactaaggtacctcggccgcgaccacgc

SEQ ID NO: 1108 - DNA, 414 bp, Trichoderma reesei
gcgtggtcgcggccgaggacaagcttttttttttttttttttttttttttggggatgatggctaactatgtatttagtctatatatgtatagataaggaaatagatgcagacactcattattaatgacagatgatagaaacatggactattttcatggagacttcgttgtgacgacacgtcatatgaatcgtcaaaatatgaaagaaaatctggcgatgggtgcctacttggcacgtcttttctaacagtgaaaggaagatgcctctatagaaagatgatctaagaagggaaggagaaagtatccaaaagtattgatgtagttgtttgttgttgttgttggcatttgacaaacaactcgaagagaatctcatgcaatgcatcgactgatctgcggctcttgtcgagtcgatgga

SEQ ID NO: 1109 - DNA, 271 bp, Trichoderma reesei
ggagcggccgcccgggcaggtactgaggctggtggctgctggcgggcaagatatcgtttcgcagagcagttccaggatgtttgctctcttggggcgagatgaatgggcacatcgactggacgttgtcaaagggcttttgaaagacttgcacgactagtcgagctctttgatgctccattgtgacgatggatatgttgcgggtattaccttacctgcgactcgttactgacatttgaccacacgatagactgtacctcggccgcgaccacgc

SEQ ID NO: 1110 - DNA, 421 bp, Trichoderma reesei
gcgtggtcgcggccgaggtacatacatgggcactttactgcttgcagcaagacgccctcccccctccctgggcaaacgagagaggaaaaaaaaaaaaaaaagaaaagaaaaaagaaagaagagaaaatattgagaccagggtccgtctcgtgttgctgtccatttattctggagccggggcgacggttaggaaaggcgccgattggaaaatggagtttagatcgtcctttggtggagatgggtccagctcgagcttgttctgatgcgattcgctgtccgtcctttttgtctttctgtctgtctgtctaataccaaatctgttctgtctgttctgtttctgtctgttggggtgtttgatctgaagctgaggctgttttgactcgagagcggtttgcatgtacctgcccgggcggccgctcga

SEQ ID NO: 1111 - DNA, 181 bp, Trichoderma reesei
tcgagcggccgcccgggcaggtaccggcgcccgcagtcccggcatctgcgttctcgcgggcatgctcctctcgatacacggcgcccgtcttgtcccaaaagaacatgacaagcccagcgaattccaagccagacatgccaatcatgaggtagtaaaaggtgtacctcggccgcgaccacgc

SEQ ID NO: 1112 - DNA, 360 bp, Trichoderma reesei
gcgtggtcgcggccgaggtacatggaacccagatcacttgatcttctagttctaaattcgcccatcatgccccgactttggaaataacttcttagtctctctctgtctctgcctcttcccccatctttgctctcttcccgccaaaaaaaaaggccaaggcgagtcaagctgttgaaaaagcaaacagtcctcctcaaaaggtcccaaaagagggttccttgatattccctcccgccaactaccgcgccgccggtcgttgacccttgctgaaaaccaaatcacaaaagagccattcctaaatgcaaagcccattcactcgaaggggcatccaatcaatgacctgcccgggcggccgctcga

SEQ ID NO: 1113 - DNA, 286 bp, Trichoderma reesei
gcgtggtcgcggccgaggtacctcatcgacctgtgggctgctgacggcacgttcccgcccgagtcgaggccttatgcatatgccaacgtcgagcgtggccgatatatccagagcctgggcacgtcagcttgagcggcagtgggaacggagaagccatgatgcaggaatccaacttatttgctatttagcagcggttacgagaactatgaaacgaggtcccaatcgcctggtcttgactgacattgagccgatcggaagggatgtacctgcccgggcggccgctcga

SEQ ID NO: 1114 - DNA, 692 bp, Trichoderma reesei
gcgtggtcgcggccgaggtacccctccctttttttgtttcattgtctgtttggctccatctcctttctctctggaagttttgtcttttctctttccttggtttctcatgttgtttccttgacggctcctgagacagagcaggtgctcgtttgtcgtgttagtcttgcgttactgagcttaatttctgctttggcttgcatttgctcttttcgttttgcatgggtccgatcggaaagatcatggggggataatactggagaggcggcgaaagcagggaaataccggcgggataaaggactttggacgtttcgcatgatttcggccccgagagggattattttggatctcgacacatcggcagcgcaagctaatgaacagtgagggcaggttgattggctggtccatgatggcgataccgcctttttcgcaatctctgcttttcttggttctaatggaccattcgggccccctttttacattctactttgataatcatttcccccctcttctttccttttcccttttcttttcttttccttccttcttcactctcgggggccgcttgcttgttgactgtcccttttcattgggatcgcagcctgatttacacttggcaacttttccaaattctcaaaaaccttgttcgataaaagaatggttttcccattgaaaccttttaagtttcttaaaac

SEQ ID NO: 1115 - DNA, 342 bp, Trichoderma reesei
attcgcccttagcgtggtcgcggccgaggtaccactggcattagctgacctcgccagcgatggagggatgtcctcaagcctatcactgggggctttaggggtatacaatctcctagctgtgcggcagagattgtcggattacattgactgcgtctgcgatcgatactgtcgattctttctgtaactggggaggagaaaaaggagaagatcaaacaaacaacacaaaaaagggaagactaaaaaaaaaaaccgcagggtgattgcattttgaggagttcggcttgattcgattcgattcgacttcctttctctcacgctggttctttgtctctttcctttatc

SEQ ID NO: 1116 - DNA, 133 bp, Trichoderma reesei
gcgtggtcgcggccgaggtaccgcggccagcgctgaggctgcagttgcagcggaaaggagactctttgagagcatcatcatgcagaggtatcagccatacgaagaaccgggacctgcccgggcggccgctcga

SEQ ID NO: 1117 - DNA, 291 bp, Trichoderma reesei
gcgtggtcgcggccgaggtgaaaaaaaactagtaatacagggcgacgcgccacgtctaatctgaggatcatgaagacggttgttttgataatggctttatttatttgaccaaacgcacccaatagggggggtggatggaacatcgttttttttttctgggtgggagttatggaaaattgattacgctttagtttttatctccctcctttctttttctccccttatttttgggggatgatatgaagaagtccagggcttctggagccatgtaatgccatgtttgctttcccc

SEQ ID NO: 1118 - DNA, 301 bp, Trichoderma reesei
gcgtggtcgcggccgaggtaccacccgtagaattgtttgaaagaactccaatgtaaaaccgcgcagctaggctaaatcgctggaaggggaaacaaaaaccatgctagaatatcatgcaaatcataatcgtgtgcgccgccctcttctcctggctgctgcaagaaaatcaaagtctgtggtatcgagctccagggttgaccgtcagttgtcgggatgccggtgccgacacggcatctcgatggggaaaacgaactacagacctcatgtgtgactgtatgtacctgcccgggcggccgctcga

SEQ ID NO: 1119 - DNA, 293 bp, Trichoderma reesei
gcgtggtcgcggccgaggttccttgtttgtcgcgcgccctctttttcgtttgcgtcttcagtctcagcttctctctctctctttctttctcccccctcaactcctaagttaatccatcacagcagccatcatgcgtgagatgttcacatccagaccggccagtgcggtaaccaaatcggtgccgccttttggcagaccatctccggcgagcacggcctcgacagcaatggtatctatggaggttcttccgagctccagctggagcgcatgaacgtctacttcaacgaggccaa

SEQ ID NO: 1120 - DNA, 537 bp, Trichoderma reesei
gcgtggtcgcggccgaggtacaagctttttttttttttttttttttttttttgaattgaggcttttttttattttacagtcaactccacgagggagcaggatgggcgttacccaagatctattgagacagaggacaccattttcatcgatgaccaccttccccaacctctaacaccgtctatgatgcacttccttgttttttctgtgcacgttggcactccaattgcatttgataaaccatcaaactccaagtggcgggcggtccaacgtcgtccccttatattagttgctccatccaccggccggagcttttcccatctctcgagaggcaatttaggtgaacttggccatcagggcaatcatgaggtcgaacagagcgatagccctcgacgaaagcgaaacccagaatggcgtaggagaagagctggccacggagggcagggttgcgggcaacaccgttgatgagggcggcgaaaacgacaccgataccaacaccagcaccgggtcagaccgatggcggaagaacccatacccaag

SEQ ID NO: 1121 - DNA, 297 bp, Trichoderma reesei
gcgtggtcgcggccgaggtccctacatctttttttttttctttctttctattccggtatgatttacccattgtatccccctataccatatttcttgccttgttcgaatcttggttcaaaagggatgggagctacacatacagtgcattgcgggcgtttatttgtcgtcgtcgggggggcatcataatgtctatatcctgcgtcgtttggatgatgacgcttggggaaaggttgcctttgggctgtatatatagttggataccaagttgtttaatgagtcacgtccatggtgttatgg

SEQ ID NO: 1122 - DNA, 106 bp, Trichoderma reesei
tcgagcggccgcccgggcaggtacaagcttttttttttttttttttttttttttttccccataaaatttcataaagctgctattctacctaccgtttagagaccga

SEQ ID NO: 1123 - DNA, 301 bp, Trichoderma reesei
gcgtggtcgcggccgaggtaccgtctcgaggtcgttcggtccaaactatgagtgtagatgatcaagcccctcgttcgttcaccacttaccgtcgttcttacggcatttcttttaacgctctctggagcttatttcataccaagagtttaatgtcatttcaacaggctgtccacgcaagtggcagatgcagcacattatcggtttgagggttagcgaagcacttgaattagggttgaactctgggatatagagcattgattttctggacggttatggtacctgcccgggcggccgctcgaaa

SEQ ID NO: 1124 - DNA, 318 bp, Trichoderma reesei
tcgagcgggccgcccgggcaggtacctagctatagctcgttatcatcatggccctcacgttacatgtagttatacaatcccatctcatccaaatgcttatcccgtcaacttccccccccttttcataaaacaaaaatggtttttttttttttttttttaagccccagcatcatccatctcgtaatcgggatcaacctcggtccccaaatccctcgcctccaagaacctccgccccagcagctcctcgggcagatagcgctgcttggccttgccatccctgtagttgggcggatacttgtacctcggccgcgaccacgc

SEQ ID NO: 1125 - DNA, 429 bp, Trichoderma reesei
gcgtggtcgcggccgaggtttttttttgcacaatccaaagcgctggttttgacgcagagccgtgtctgtctctatcaattcgcgagatgtcctccccagagccatgttctagaataaaaagctcgacaagaaagagaaaagattaataggcttatagtagtaggtggagccaacccagtacactcatacagccgtatataaaaagcatacagggcatgacgtctttcttgagagctttagctctttccagcaattctgctgaagatggaagaaccatgagacttcttgccttccaggatttccagcatgttcttccacacctcaccaggctgctggctcgcgtccacgcccttccagatgccgctcttttggtaatactcgaccacaggggccgtctgcttgtggtaagtcgcaagacgcttcttgagg

SEQ ID NO: 1126 - DNA, 606 bp, Trichoderma reesei
gcgtggtcgcggccgaggtggagagcttgtccaggggttatgtgccatgctgctgggggttgtgtatgagttctctacaaaggactcgcccataccacgagcaacgctgcattccatcttggagtcgcggctggacagagatgggtacgtggaccgactgaccaaactccggaaccatcctttgctccgagagttcgaggtcacgccgcaaaaactcatgtctacccctgaaggcgaggaggtcaacgtctttttcgacgatgtctttgtcgacttcttcaaggacaacttcagccgtgccatccgcgcccttgacaaggcgcccgatattgaggtctcggtcattacgaatggaacggagcagggtatttccagacagctcgtagactccttacggcagcaaatagaggaaaaagaccgcgcaattgaagaagccaacagcgccaacagatccctggaaggggtcattaaggaggtgcaagaggcacaccgccgtgcaaaggaagacgccgaggccacgggcgcgagattgacggcagagatgcgcaaacttcaaagcgagcaggctgctacagtctctgggcttgagcaaaggattgcgcagat

SEQ ID NO: 1127 - DNA, 456 bp, Trichoderma reesei
gcgtggtcgcggccgaggtacagagttcgcgtaaatctgacagacgaagatttcaaagaacggtgaaagcgagaggaactgcttcaggaaacgactcagggccctccagataccacgctcagtcaactcctgcactatcagaggaacgaacgacaggaagaagacgaagaagatggagaagacacagcgctggacccaatccatcaatgcgtccgtgttggcgcatccggtggggaacaggggatcggtgatggggacgtctcggttgtagtcgcatcggatggtctcgtgtcgcagagctgcaatgttcatgagcgtgatcatgaacatctgaatggacaacatgatgaacatgttgttgacgtggaagccggcgtgggcatagtagaacgacaggaagcggtccaaaggcagctgggttcccaggtaatggtacctgcccgggcggccgctcga

SEQ ID NO: 1128 - DNA, 560 bp, Trichoderma reesei
tcgagcggccgcccgggcaggtacttgtgctgggggaaaacttcagcgaaaccatcggcagcctcgacgaagtcgtaaacctcagagccgggcatgtcaccaccgccaccgagaccaaggcgctcagcgttgtagacgttggttccgagaccgagctggcgagaagtctcacgagcgataccgacggcgtcaccagtcaacatcttgatggacagaccgagctgcttggcctcgttgatggtgcgggcagtgtcgtgacgaggggggtcagagcagggcataattccgagaatctcccaagcaccctcaccacgcttgcgggcaacaccgagggaacggaaaccacgggtagcgaactcggcgacgcagttcttgtaggccttgtcaatctcctcggggatggggtggtcctcctcgacggtcttgagaacgaacagaggggcacccttgacacaggtgatgcgctagccctggggagactcgacaacggcggtaaccttcttggagacggggtcaaaggggtggaactcaatgaccttgtacctcggccgcgaccacgc

SEQ ID NO: 1129 - DNA, 448 bp, Trichoderma reesei
gcgtggtcgcggccgaggtactgtagttgtagactaataagcgagactcgacagccatgagatgagatgctgtccgatgagggcatctggatgaaaggcaggcatctactaggtatgtagacgcttcctcttcgtcgtggatcggagccactgcccgccttctccaggcaatcgaggggaaaaaggaccctgaaaaaaaaagagcacaaaatgcatccatttcgcctcgcttccaactccacccgcgccagtcgtgaaaaaatgcagaaaatgaaaaatgagacaaaacgagaaaaaaaaaaagaggcctagctccatcagcgaaacagcctgttccccgtcctcgtcgaaaatctctccaccccggtcccctgctgcgcgtgccacagttgctgcactccaacccctcggctctcgtggctcagcttgtacctgcccgggcggccgc

SEQ ID NO: 1130 - DNA, 163 bp, Trichoderma reesei
tcgagcggccgcccgggcaggtacatcgtcaagaccaagcacaaccccgacatgttcgtcatgaacccccagtcgtccaccccctggatcaacgcgggcgccaaggacaatccgctgctcagatactggctgctcaaggccggtacctcggccgcgaccacgc

SEQ ID NO: 1131 - DNA, 216 bp, Trichoderma reesei
gcgtggtcgcggccgaggtacgccgaatgacgacggcaagagatccaactcgattgctattggcaatgaagactacttcatgtcggctctgcggctcggaaagagccgaccgggaactcctcaagccggccccaagaggaatgccacattctcgccgcgcatcatcttctacgacacttggcccagccaggagtacctgcccgggcggccgctcga

SEQ ID NO: 1132 - DNA, 434 bp, Trichoderma reesei
tcgagcggccgcccgggcaggtaccctcgaatatgcgtgaagggatacaggcccatcgaataaagcagttgactgacattgctgacgtttagggcaccaatcgcatgatcacggggatctgaatccagaagtgtcagaggggagctcccaagcaatctgatggcagctcaagtttcgtttcaatgacataccggttggccagggacacattggcagagtcaaaaggcgcgactctatgtcagtgaagccggcgtttctcatccaatctttgaggcgaagagctgcccgtgggtccttttgaggatgtagggcgtcgaggtatccgcgagaccatctcgaaaagttccattgtctgactgagcattgaaatatatctcaacaagttgacaccaaccaccttgcagcagaacgcggtacctcggccgcgaccacgc

SEQ ID NO: 1133 - DNA, 146 bp, Trichoderma reesei
tcgagcggccgcccgggcaggtacaaaaagtctctaaacaccggcgacaactgctcctcgttcttgatctgcggcgtcccgttggtagcgatgagccacagagctcgtagaggcgattcggtcaggtacctcggccgcgaccacgc

SEQ ID NO: 1134 - DNA, 365 bp, Trichoderma reesei
gcgtggtcgcggccgaggtactcaaacaaatcccctgggaggcagatactttacgtttctttcccccttggactcagttccttggccttgatctcccgtctttgattcggttagcttttcatttttggaagtgcctgcgatttctgctctttttttactttcctttctcttatttcatcacttcttctttctcttttccttttcttctttttcttgccccctccctcttcttcttcccctttcctttcttaggcccctcttcagtctttcttgggctcatcggcggaagctcatgcaatgtggagcgacagcggatggccttgactcaaaaaggggggaggcacaaggggttgcaatatatttca

SEQ ID NO: 1135 - DNA, 288 bp, Trichoderma reesei
cgagcggccgcccgggcaggaagcttttttttttttttttttttttttttttttttttatcaccagccagaaccgtagattcaaagagtcgtctatcgagtatctaacacggcagtattccttagccatctgccaaatcgtccccctcatccacagaattctgtcatggctagcccggatcatttgacatgaacctgatccgagccacatccatcgtcttgacggttgcggagcgtggatatcctctttcccccctctgtatcttactacgagaagagggagaggaca

SEQ ID NO: 1136 - DNA, 571 bp, Trichoderma reesei
gcatggtcgcggccgaggtaccgtcattatgaaccaccctcccaacaacgtttaccagcaggtcattgagaggaccaagggcggtttcttcagaacacaagtcctcaacgccgctgtctccaaataagagagaagcgatagaaggagcttgcagatgtgtttgacatggcaaagcaaaattgcctggcgctgaacaagggtatcattctcgaataaaactttgatgccgagtctgggaactcggccacgcgggtgaacgctcttaaagaccaaaaggaaataccaatgtttctttctcaatccaaagctcctcgaagacggtcggtttgccaaaaagggaagaagatcaagggagggaaaaagcaaagaaagactagaccggccccttgttttatatcacatggtctttattttttttattatctctcttcctctctctgggatgcggttgcattgcacggcgttcataggtataagacagggatggggaagatgtcttcttgagggatgataggccagggtcgtttttccagtaacgatggctctaattgagattgacttgtttttgtgc

SEQ ID NO: 1137 - DNA, 343 bp, Trichoderma reesei
gcgtggtcgcggccgaggtacactcgctctcaatgacgttaccctacatatttgtatgcatatcccagccttcagccagggcaatacatatgtaattctcagccctgcgtagccgtggcgatggccatggcgatgatgcatacactttcttgtgcgaggcaatattatccccggacaactccaagcctgaagaagacacacaccataatcattattgaatggaatttggaatatccgcggcgcctcctcagaagggtcacattacaggtgaacaccgctccgtcttcgcagcaacgaggtcgagaacatcacaggtcaagtacctgcccgggcggccgctcga

SEQ ID NO: 1138 - DNA, 376 bp, Trichoderma reesei
gcgtggtcgcggccgaggtacacgagtgacggagtgcccatcatctggccgcagtggacgatttcgtgtggcgggctcgacattcccgtctgcaggctatcgtttgcacagttcgacgccatcacgtctcggggcaccggccgcgcccaactcgcaggcctgatgtccaagacgtcggatgacattgctgagatttaccagatcctggcgacagctggtattactctaaaggaggcgctggccattcttcctcctggtatccacgtcaacctgcaaattgtatatccgaacgcagaagaggaaaggacgctggccttgggcccggccctcgacgtcaacgactacgtcgactcgatcctgacgattgtctttgaca

SEQ ID NO: 1139 - DNA, 170 bp, Trichoderma reesei
ggtttagactttttgtatattgtatattgtattcttgtttttcggaaatcaacagctatcctatctgccccagtaaatcaaaatcaggatcgatccagcagaaaagggaagggaagagaaaaaagcgtcgatgtgctttcttggtaatagtacctcggccgcgaccacgc

SEQ ID NO: 1140 - DNA, 460 bp, Trichoderma reesei
gcgtggtcgcggccgaggtactccgtggaccagaagcacgaggggagggacagccagctgggattattgcacagacaaggccatctggaacgtgtgcgagtaggagccctggatctggaccggggccggattggtcgctctcttatttaactttaaaaacaaagaaatcctcgttggggaagcaaaagaccaagaagcgaagaaaagggcttacgtccgtcagcgtggcgcagaagaatcggactttggagacgtagccaagggaagacgacgaaggagaagagccgagccaggctaggaggcgatctcggagagtggagaagcggagagatcgggacgtgcctatgcaaaaattcaaagagaaaaatgatgagcacgaaaagacacgcaaagggcgatggaaagttgctcagacgaagcaagagagagagcacctgcccgggcggccgctcgaaaggcg

SEQ ID NO: 1141 - DNA, 396 bp, Trichoderma reesei
gcgtggtcgcggccgaggtactcagaacgaggcaatccctgttcagggcaacgatgctccagtcgaagacccaatccaggcatcagctacggacagcgatgagcaactggcacaagatgacagagaagccattgacaagtccaacatcattggcgagagaactcgtggttccaaaccgatggggtcgtatcaagagcccagcgatgagcagatgggattgactgaataaacttgagagggattgattgaataaaacttgagaatctcaatgataaaaacaatgtaattgattgaattatcagatgtataattattagatgcataactctgcaatttatgtcatgaaacatcgtacgagttcttggggcgggattccttggccttcctcatgaagac

SEQ ID NO: 1142 - DNA, 491 bp, Trichoderma reesei
gcgtggtcgcggccgaggtacactttggctacagttggggaccttgcgcctggattctcatcgctgagatctggcccttgagctctcgaccttatggtgtttctctgggagcttccagcaactggatgaacaacttcatcatcggacaagtgactcccgacatgttgcaaggcatcacctatggcacctatatcctgttcggaattataacataccttggtgccgcctttgtctacttcttcgtccccgagaccaagcgtctcaccctggaagagatggacatcatctttggcagcgagggcgccgcccgtgccgactttgagcgtatggaggagattaacaacgagattggtctgaccgcaatggtctaccggtcttctcctgacgaggtggtgactgttgaagctgagaaggccgcttgaatagcggaagcacccgggcgcttcttcttttttgtaatcgaaggacagagattgatagttatgaagctg

SEQ ID NO: 1143 - DNA, 446 bp, Trichoderma reesei
tcgagcggccgcccgggcaggtacctgggatacatgatctacagcgtcgccacgcacccgacatcattccctctctggtccctggtcatcctggctgccgtctacggtcttcaggcgttaatcttcatcctcaagagacaatggcagcacattggatggatgatcatctacatccttgcgtatcccatctactcgtttgccctgcccgtctactccttctggaaccaggacaacttctcctggggtaacacccgtgtcgttatcggagagaagggcaacaagcaggtggtagctgtcgacgatgagggctttaacccggcttccatcctcctgcagcgctgggacgactacgccctgatgaacggcctgccgggccgccgtggcaactactttgcccatgagaagcaggacatggcttttgaccagtacctcggccgcgaccacgc

SEQ ID NO: 1144 - DNA, 472 bp, Trichoderma reesei
gcgtggtcgcggccgaggtctaccttctctccgctccctcctttctgcaaaccttccacagtcaagaacacgcatctatcacaatggaatccagcagcaaggctcccgttaagctcgtcaaggtgacccgagtgctcggtcgaaccggctctcgtggtggtgtcacccaggtccgtgtcgagttcatggacgaccagactcgttccatcatccgaaacgtcaagggtcccgtccgtgaggacgacatcctctgcctgctcgagtccgaacgcgaggccagacgtctgcgataaatgttggaaggctggagtggtggaaaacaaagcggatggtagagtctctcaatggcgtgaacgggtacgagtctcggtatcccagcactcgcgcgcattcagtggccagcatgaacaacttgtcgccgcggtttggaaccaggaacgtgcgacaccggtacctgcccgggcggccgctc

SEQ ID NO: 1145 - DNA, 501 bp, Trichoderma reesei
gcgtggtcgcggccgaggttgcgtctataactatatcacctttttcctttgtattttctctcttgacgcttatgccctcttatcctttgccgatcagaggacgtttcatgttacataccttttcataccgacgtcgtcattcgacatgattcgactctccccagaacaataccagattgcaatacacacacataccgacacacccctagaagagatacccctgtggaatttgtttgatgattcacatcttttgagatacacaacacaaatttctacaaaaacacacacacaaacaaaagtgttcacccttgcttcctccagactggtggtttcactctcacagaatggataccgcataaacgcggaaagagacgccttcgttctggaggactggtttcagattgtcggatgccgttttcgattccatcctcttctttttttcccttctttttctttctataaattcttctttctcaggtacctgcccgggcggccgctcga

SEQ ID NO: 1146 - DNA, 511 bp, Trichoderma reesei
gcgtggtcgcggccgaggtacaggcacggccacgacgaggctgaacgtcccgagcggaaagtatacggttgctgtcaattactacgacgtgatcaatgggaccgccagctacgatgtgctgctgaatggcaagtcgctcggcaagtggaagggcgactcggaaactcatcttgggcacgacttcagcacgtttctagactgccattcggcgatccgtatcacgtttgagggggtaaggatctcgagaggagataagctgaccatcagggggacgggcaatgctcaggagcaggcggcgatagactatgtgtctatcctacctcagggggtggtggattagttgtatatcggaaaatttgcttttgaacatggagggcaaatcttaagaaattgcaactataattactttctcaaaaaaaaaaaaaaaaaaaaaaaaaaaaaggcttgtacaaaacctgcccgggcggccgctcgaaagggcgaattccagcacactggcggcgtactagtg

SEQ ID NO: 1147 - DNA, 583 bp, Trichoderma reesei
gcgtggtcgcggccgaggtcgtgactacaagaagaagggcgtcaagtgggtcgccgttggtgactggaactacggcgagggcagctcccgtgagcatgctgctctggagcctcgtcacctgggcggcctggctatcatcacccgaagcttcgctcgtatccacgagaccaacctgaagaagcagggcatgcttcctctgacctttgctgaccctgccgactatgacaagatcaagcctgatgaccggattgaccttccctgcaccaagcttgctgttggcgagcccctcatcatgactgtccaccccaaggagggcaagcctttcgatgtcaagctgctgcacacctttaacgaggcccagattgagtggttcaagaacggtagcgccttgaacaccatggccaagaaggcccagaaataaaagaagagaaaagaatggggtgtggaagatggcggcgtgaaagtcatggcattgaaagcccgcaatctcgtgagctctcgcgagttatgaagaagttgtcccggggcggtattatcggctcgatgcgtctggagtcattatatgcttttgagtgtacctgcc

SEQ ID NO: 1148 - DNA, 392 bp, Trichoderma reesei
gcgtggtcgcggccgaggtactcgacctggtccgagtctgatctcaaggagtggcttgacacccacggcttccctgcccctcagcccaccacccgcgacaagctgattgcctcggtccgccgcaactctcgcctcgcctacctcaaggccaagagcgagtctgatactgctgctgagaagatccaggctgcctatgcctacctgactgacaccatcattgacgcttggagcgagtcccagctcaaggagttttgcgacaagaacggcatcccggttccccagggcaccaaggtcaacgaactgagggctcttgtccgaaagcaccgcgctgagcttctgggcgacaccgtcggtgccactgccaagtctgcctttggcgccgccacttccaa

SEQ ID NO: 1149 - DNA, 418 bp, Trichoderma reesei
gcgtggtcgcggccgaggtacataccctgacacatccgcacaaaatcatatgcatgcacacttctctagtggtggcgtcatgtgcattggaggagaacattgcgttctgggttcacgcaaactcttgaagaagtgagaacagagaaaaggaagaaaaaggacgaaaagcatcttaaaaaaaaaaaggcactactttttctctgctttctgcaaagaaagtaggtcaaaacctgcatcaggcttggatggtctcacgaatcactggtgaggtggtcatggcagatatacaaacgagatctactcatgatatctgatgagacttcttccgagaggcttccgggctaatctgtcactgtttctatggctggcgttgggggagggaaatcgaatcttttctggtacctgcccgggcggccgc

SEQ ID NO: 1150 - DNA, 300 bp, Trichoderma reesei
gagcggccgcccgggcaggtatgggaattgtgatgatttttgcatgagtcatgatggttgttgggaatttgttcacgctcctttttctttctcttgatgcatcggttatgggtgtttttggcatgtatgcatgggagtcatgatacgagttacagcctttttgttgtctcttaacgccatcgataacctcacccgactgcttgtgaacgcagtcactagggatgaaaagtttacgtattcacgatccttaatacataagtttttattctaatccaaaaaaaacctcggccgcgaccacgc

SEQ ID NO: 1151 - DNA, 247 bp, Trichoderma reesei
gcgtggtcgcggccgaggtactggtatggtggctggtgaggtgcggccggggaggctgcgacaccgtctgtgtccatggtgtgcaggtgatttcttttgcctgtttctgtttctgtttctgtttctgatgctgatgtgtgtctttgtgtcttgatttattcaccgtatagcaggcagaagaagaggcaatctcttatgagacgaggcagaaaagatggagagaacacctgcccgggcggccgctcga

SEQ ID NO: 1152 - DNA, 226 bp, Trichoderma reesei
gcgtggtcgcggccgagctgcctgctgccattctctcaagccacacgcctgctttcactacacactacaacttttcttttaactctctcttcgctcctttgacatcatctaccttacctattcgcgccagacaacctcattcaacaactgcttcgtccctttgcaacgagcctcttttgcgcctcgtttttttcccgtccttgtacctgcccgggcggccgctcga

SEQ ID NO: 1153 - DNA, 347 bp, Trichoderma reesei
tcgagcggccgcccgggcaggtactgcttcgccataccaaagtcgaccacgtgaatgacattggacgccttggtgccgggtcgtccaatcaggaagttgtcgggcttgatatcgcggtagatgaggttcttttcgtgtatcgtctggactcgggaaagcatctgcttggcgaccatgacgaccgtcttgatggtgaaccggcgtccgcagtggtcgaagaggtccccgagtgaaggtccgagcaggtcaatgacgaggatgttgtgcagaccctcctgtccaaagtagtagacattgggaatgccggggcaaccaacgagaattttgtacctcggccgcgaccacgc

SEQ ID NO: 1154 - DNA, 309 bp, Trichoderma reesei
tcgagcggccgcccgggcaggtacccgcctttgtcccgtcttgcttcccccccccgcttatatcgtaaagccgtctcttgcttcaccatgacccagcatatccaatgattcattgctctagagatcaatcgtccagcttcatagccctctcatgtcatgttgtgcgttgagccaaaagaaaacaaaaagacaaaaaccaaagaaaaagggatagaaaacaagaaaaacattctcttgcccagccatatccgttgaacccatcagaaaacaagtcttgttcattctttggtacctcggccgcgaccacgc

SEQ ID NO: 1155 - DNA, 537 bp, Trichoderma reesei
cagaattcgcccttagcgtggtcgcggccgaggtacattttgaaaatcagaaagtaaagactgaggggtttttgaggtaactaaattttcagatgtagagtcaataattatacctttctttcaaaaatataaagttgtaggtgtaaaggctaaagattttgcatcattttgttttatatgtaaaatgatgaaagaaggtagacataaaactgaacaagggctacttgagattcaagctattaaaaataacatgaatagatctagaactctgtctgaatctatagattaaggattagaaggaagtataattttaggattagctcacgtatttgtttctagtggtctattcatatgtgcaggtggtgtattatatgatggaactagaagtatatacttctatagaggtatggcacaactaatgcctatatttgctagattattttttagattatctttagggaattgtgggggtcctttaactcttaatttcataagtgaattgaatgtcactttatggagaagattacctatattagg

SEQ ID NO: 1156 - DNA, 432 bp, Trichoderma reesei
gcgtggtcgcggccgaggtactgcaaggaagaaaaagccaaggttgagatatctttgagtgatgggcgccggacaggttaaattaggtgcttctgttaccttctcgtcggaaagtcaaatatcctccagtatcctcaccagttgattaggttatttggcatcacgatacatggaaagagggtggtgacggggtgaaagtctgtgaagtgatgtgcgtccaagagcaacacattgatttgtgatagtgacgaaaccaccaatagttgcatctgatcaggaaaaacatggcgcatactggctggcctccatcaaagtgtatggccattgtccagctgcatcgaagctctcgtatcaccatccacgagtggctcatcgcgtgcttgtctcacactggatgcatacttgtatgtacctgcccgggcggccgctcga

SEQ ID NO: 1157 - DNA, 507 bp, Trichoderma reesei
tgagcggccgcccgggcaggtactagagaccgactcttcgacaacttggtgggtaagctaatcgcttgacgagtttccttcgcatcctttctttcacctctcaaagggtaagaagcctgccgtcctccaccagcacattttccagactctagatcgccaagttccggccgcccccatccaccactatcatcctgcgctgtcttttgcctacgaatcttgggccccattggtggtaactccctttgtcctgactttcacggccggagacgacgtttctcaccaatcactgagtatcgatcagctgtcattattggacagatgaccttttaatcataggacgcggcgagaaggttgtagtgtttctcgcaatgtattatagcacgttttggcaaggattaacaggttgaaaacaattggggagcttcaggtaaagtcagaggtaagctcttgcgacccgactgattgcgaatatcgaggcaattgcttgtcatttctgcgcgacaaagg

SEQ ID NO: 1158 - DNA, 144 bp, Trichoderma reesei
tcgagcggccgcccgggcaggtactggttgaaggtcgctgtgccctggatggaaggctcgttgacacgggtattctcccagatggtgtaagtggctccgtcgctggtgacggttcccttgacggcacctcggccgcgaccacgc

SEQ ID NO: 1159 - DNA, 365 bp, Trichoderma reesei
tcgagcggccgcccgggcaggtcgccccagcaagttgaacagcaggtcgggtggtgagaacggctccgaacgatctgcatatggcagccaaggtagtcttcaacaaccactgcaataggggcaattgaagccttgaatcaccctgatcacagaaatcgccgtctgcatcctcctcgtcaacgtcacttcaatccgcataccaaacgttcatcaattctttacctctttcccttacctctatccttcgctccggaacctctatacgcggcgttcgacaaggaacgacgctcttgagatcaatcggctcaggccttcaagaagcaatcaccaacgggctgcttggtgtacctcggccgcgaccacgc

SEQ ID NO: 1160 - DNA, 322 bp, Trichoderma reesei
gcgtggtcgcggccgaggtaccacggagcagacccgtccttctggcggcaatgagaccggccttctgtccctgcacggcataccgtgagatggtagaggccttaccaatgtgctggtggttaccaccaccgtgagggtggtccacggggttcatggcaacaccacgagtcttgggccagctgttacgcttgacagcgaacttgtgcttggcacgagaagccttcaacagaggcttgtcagttcggccaccaccggcaacgatgccgatcattcctcgggatcgggagtggacgaccttctacctgcccgggcggccgctcga

SEQ ID NO: 1161 - DNA, 382 bp, Trichoderma reesei
gcgtggtcgcggccgaggtgttcctgcataacatcatgccgacgttggtggatgttccggatcgtctgaggaaggaagttttggaataccttggacaggtcgaccagacgttgaagcactacttagagcaggggcttgcacaaagatccaagtagctcaacaccaggcttggttgattggggctgtatatgtatccatttacttgtgttcaaatggggaggcaaaatgtgaataaaagtgcctatcagctcattacatcggtcatcaattaacctgctagatgtgcatggctgatagtgcatgagttctgcctgccatcactgttagcaaaaaaaaaaaaaaaaaaaaaaaaaaaagcttgtacctgcccgggcggccgctc

SEQ ID NO: 1162 - DNA, 348 bp, Trichoderma reesei
tcgagcggccgcccgggcaggtacggcgctgccataacgacaagctccagccagcccacaacgcccatgttctcttaccaggtgggcactggctatttcccaggctatacagacggctcggactacaactgggccttttcatcccacaatggagaaccttcttcaaactttgccattccctacgcctcttccatgggtatgctttgattttggatatgcaatctcaatgctgcatgcatcctagcgctgaatgtgcagcgcagcattatgtctgttacgcctacaaccgtccggaaaatcatgtcgcgggcgatctcatgcaatactgtacctcggccgcgaccacgc

SEQ ID NO: 1163 - DNA, 458 bp, Trichoderma reesei
gcgtggtcgcggccgaggtacaaatcttttatttctcgactttctcttctatccttttgttttctcttggccattctttcggatatggctcatttcacttctttgtcgtttgagcgcaaaagggcaaccaacaatccctggacaaagaaatctttccttctttcaacgtgggtggttgggcagagaattgttagatatttcattttctctttcttgctatctttcttcctttcttgcccttcactctttcttttctctccttgtcctcccttggtatttcttaaatcagatcgccgagaggagagatactatttcgtaaagtgatgacgaagagcatctacagttttgagtctctacgggatttcccagcctcctccgacctttgttgagttgcgtgggtagatagtggctgtgttgttcttggatagcttcttgtacctgcccgggcggccgctcga

SEQ ID NO: 1164 - DNA, 468 bp, Trichoderma reesei
tctagcgggcgcccgggcaggtacgagaagcctgtcatcaccaaggagcttgttgaagaggtcattgagagctacaaacagatgaagtggtgggccatgaggagtgtcgagcaggaccccacgtaacgcttgatacgcgacacatccaaagcatgactgattcgatgccgattacatttcgacacatgagcatatttgaaaagcaagcggccgattgacgcccacgccgacgtcgtggttgaacagcttgcagacgagcgcgggatagcccttggaagcaaggatacaccaagcgttggtggagattggatctaccaagatgccgattgaggacccgaaggagccagcaaaaacctctgggcttttgtatcattagatattcacacggtcccgaaagagtagcacgatatccgcccgggagttgagttcaactacagctgcagggcttggctttttttctttgtcttt

SEQ ID NO: 1165 - DNA, 397 bp, Trichoderma reesei
tcggagcggccgcccgggcaggtattggtcttttgggcccatgatcggatgcaggcatcgtggatgatgtgatcacagccatcgagagcggccacaatgtcgagatagctcgactcgccctcgacggcctcagcaatggaagctgcagcggcgttgacggcgccgtcagtcgcagccgaggggcgcggcagcggatccaaacatatgatgcactggtcaggctcagacatggtgccggtcgtgttgatggccgccaggaactgatggaaacatgtaaaaataaaaagaagacgacaaattcaacgatccccgatggaccagaaaaagattcaagatgtcttgaaaagaagacgtgggagacgacgggtgtgtggcgtgacctcggccgcgaccacgc

SEQ ID NO: 1166 - DNA, 247 bp, Trichoderma reesei
gcgtggtcgcggccgaggtcgtgaatgcatcgacaaccatcaaatgctctccccaggtcgacgccaaacagcatcaccaaaccccttcattcaacatggaaaccgagagtccgtctggcgatactagctcgacgcaacccctctccccacccgggtcagtgaatctgtcctagtggttcacgcggcccttcgcctgcgtgaattcacgcgtcgccttactcgccggtacctgcccgggcggccgctc

SEQ ID NO: 1167 - DNA, 55 bp, Trichoderma reesei
tcgagcggccgcccgggcaggtacgccttctgcggctactacttcacgtacaagc

SEQ ID NO: 1168 - DNA, 373 bp, Trichoderma reesei
ggcgtggtcgcggccgaggtacgtcgtctggtaatctggttcgttcaggaatcccagatgcgtgatgttgtagcctgctgctgcgtagtatttgacgtattgcactagaaagtttgcatacgcttgtctccagtcacccgaggaacaagaatggccagtggtgccacagagataaccaggggatgagtccgaaccgctggtcttcatgaaaccaggtgcaccccatgcatcggcatagatagtctttacaccgtatgagacggcctgctgtgtgaaccataattgcccactgtcattgttatccacacgtagttcggcgccgcggatggagagccgggttgttcggttcgatgctgtcccctgcaccgcccga

SEQ ID NO: 1169 - DNA, 62 bp, Trichoderma reesei
tcgagcggccgcccgggcaggtacactttggctacagttggggaccttgcgcctggattctc

SEQ ID NO: 1170 - DNA, 160 bp, Trichoderma reesei
tcgagcggccgcccgggcaggtacgccaatccatggacatagcgagggtcacccatgaagatggcggctcggatagcgctgacggctgcagcgggcagaggaacggcagtgttgggataaccctcggcagggtcacctcctccacaaagagcgtcgtcca

SEQ ID NO: 1171 - DNA, 293 bp, Trichoderma reesei
gcgtggtcgcggccgaggtacaaaaaattatacaaggtatcggaacccctttctcatccgcagagcctcgtcgatgtcctccatctcggcatgcgcagtcttctccagaacatccggcttagcctcccaggccacctcgcccgcctcaagcttcttgttgaggttggtcaggatcatcttgaacaagaagttgccgacaatggtaactccaaacatggccaagacaatgccatagctcttgcggtagccgttctcggacaggtcccagacgtacctgcccgggcggccgctca

SEQ ID NO: 1172 - DNA, 186 bp, Trichoderma reesei
tcgagcggccgcccgggcaggtactacaaggtccgccagctcttcatcaaggactttgacgagaacatcattgccaacctgagctcggtggttgcccgtctctgggggtccatgttggacgaggttgtcgtgtggggaatcacgcgcctcatgggcgaatcattcaagttgcactcagaagccctt

SEQ ID NO: 1173 - DNA, 204 bp, Trichoderma reesei
atctgcagaattcgccctttcgagcggccgccgggaaggtacagccgtgcttcatcattgccgacaagagcaaccccagtgatcgatttgtctacctggtcctcgacacgcagtctggagacacggccatgcgaaatggcttccttggacggcctgaaggtcttgggtgatgaatatgccgtctatgcgcagaacaatgtggct

SEQ ID NO: 1174 - DNA, 148 bp, Trichoderma reesei
gcgtggtcgcggccgaggtacaacgttggatcttgccaagctcagggttttgctccccgtagtgtcggctttgtttgccccagcggaaacaagatcaagtcttactgcgatgcttcggacccgtacctgcccgggcggccgcttcgaa

SEQ ID NO: 1175 - DNA, 188 bp, Trichoderma reesei
gcgtggtcgcggccgaggtacggaggagtgtgtttctgccatagcctcatcgacactcccaggacttgcgattctgttcgcaagagcaacctcaagttcagtcgaattgtaattaatttgcagcccacatatcttggcaagccagaaaccagcgtcatcagtcatacatacgtttctcaataaatctc

SEQ ID NO: 1176 - DNA, 175 bp, Trichoderma reesei
gcgtggtcgcggccgaggtaccatcatggcaagctggccgttgatttgatcctcggacttgttccctcccagccttcgcagggttttttggcgtcctctacacggtctctccgcacaagataccaaggcgattcgggcgcaaaaaagcacacaatcatgagagggaccggccaaa

SEQ ID NO: 1177 - DNA, 395 bp, Trichoderma reesei
gcgtggtcgcggccgaggttcttgccccggaaattacccctgtgcttgcctctgcggttgctcctatcccggctcttgtggctgctgatgttaccgctgtggttgctaccgaagatgtgactttggttgttgagtcaagcgagccctttcggccaccgctgccctggttctcacaccccgacgttccatttcccaaaagaacccctcgatcaaaacggcaaagcaagcttcttattgcggaaggaggctcgatcgtgctccctgtagtagctcttgaacagaagtccagcgaagagcctgcgatttctgccaagcctgaggctagctcccaacctcaacagcaagacggggagacagaagctgggcaagcccctgattcaggagacctccccagc

SEQ ID NO: 1178 - DNA, 138 bp, Trichoderma reesei
gccgaggtgaggcgaggagggcggtgctcaagcggttgggttggtataatgctactgaggtgccgtatgcggagggggtgaggaggagggatccgaggctgtttgggaagaagattggggttgttgagaaaggggggg

SEQ ID NO: 1179 - DNA, 203 bp, Trichoderma reesei
gagcgcccccccggcaggtacttagtgatgatcttgatcacggcgaatgttaagggaggatcgatgctatgacaggctcacgagcgggggggtaggaatcctgaatacagggtgttgccgagtcttagtagtcagacaagagaggaactggcttgaatatttatacaactacctcttagaagagcatatctccgcaacttcat

SEQ ID NO: 1180 - DNA, 107 bp, Trichoderma reesei
cgaggtactgggtagtctgccagatgaagtcctggaggagattgccgtcgttcttggacagcaggagtggtttctcgggcttcaccacttcctttcatcctccacca

SEQ ID NO: 1181 - DNA, 152 bp, Trichoderma reesei
gcgtggtcgcggccgaggaccagtcgaagaagctgagcttgctgtcggggatggagattgcgccgggcgtgtagattgtcttgttgtaggggaattggactcctcaatcagatggaacgtgattgtgtcttccaggcgaatgagctggaagc

SEQ ID NO: 1182 - DNA, 161 bp, Trichoderma reesei
gcgtggtcgcggccgaggtgtgtcacctgtgtttggcgtgtattcgtgcttcggttatgggaggattcacagcagtcatatatcgatttacatctcccccctccctaatatttatattaacccccatcttcaccactacaactacatctctctcgaattta

SEQ ID NO: 1183 - DNA, 604 bp, Trichoderma reesei
tcgaggcggccgcccgggcaggtacaggctcttgaggcttgtgacatgcagggtggcctggggcactccttcaacaaggcgaatctaggttacgacatcctgggattgcagatacttcttggatggctcagcagcgaacgtagcaagacgaatctcctgttcatcggtttgtatactggatcgctgaaacgtaaggatatccgtcatgtcgcgtatagaccgacgcgaatgtgagccgtcaagcgatcgaaccaagacaagggtctcgtccggcccccaagttggccttgacggagccgctagctcgttatcttcgggggtgacgaccttagcctgacgttcgtagggggacttgggaagacctttggcagatggagaagcgttcaactcccggcgcgccggcttcggcttcggcttctcaaacaaggagttcatcaggtcgatactcgtggcaaatccatggccttgatccataccaatctgggcacccatcgcagctccatctttcctgtcagaccgggtcaagcttttgccccagatggacgacttccgaaagtccgcctcatcgccgagatcaaacgaaacacctcggccgcgaccacgc

SEQ ID NO: 1184 - DNA, 93 bp, Trichoderma reesei
gcttcaataatagtttttaaattattggactaaccataggattcgactgctttcttttttcaccacttcacacaaccactgccattacttcac

SEQ ID NO: 1185 - DNA, 216 bp, Trichoderma reesei
cgcgccgaggtgccaccgtctaagagcccttttttgcttcaatcgagtctgcagctcctccatcaccctcgctgtcttggatctttttgccttcttgtcctttgtttttcctctctttctttttctttcagtgttttcctttttcctcttcctggttttcctcctcgccttcgctcccgttcgcaaaattcctgacaaagggggggatatcatcaa

SEQ ID NO: 1186 - DNA, 174 bp, Trichoderma reesei
tcgagcggccgcccggcaggtacaaacgaatgttgccggtaaatagatcattccgaggacggcaatggacttcatgaggcttccatctcgctgagcgtttctgccaccgccagctactcttggaaatgttttcgttgagctttgcatctttgcggccaatatgattgagatcca

SEQ ID NO: 1187 - DNA, 216 bp, Trichoderma reesei
tcgagcggccgcccgggcaggtaccccaagcgaaccagaccagcggcactaccaaagatacccaagccaagaatgatccgcaccgaagactggccttctctttggcatctgcagacttcgcaacatgaagaacggggtgattgcgcaggtccagtccacgatggcgagaacgacacatccggcataactgatgatgatccaaccgtacctcggccg

SEQ ID NO: 1188 - DNA, 219 bp, Trichoderma reesei
gcgtggtcgcggccgaggtacctgagtgatctcgctacaccgttcgccagcaaatcgttggcgtttgataagaacgacaagctgggcaaagagtccatcgacgagctcttcacttacatggacgacacggaccctggaaccctgctgtggttcatcatcttcaactccgagggcggcgccatggccgacactgcatataacgcaaccgcatacccgcac

SEQ ID NO: 1189 - DNA, 24 bp, Trichoderma reesei
ccagacatgacaatgttgccgtag

SEQ ID NO: 1190 - DNA, 23 bp, Trichoderma reesei
tttcgctcttcctcacgccattg

What is claimed is:

1. A method for monitoring differential expression of a plurality of genes in a first filamentous fungal cell relative to expression of the same genes in one or more second filamentous fungal cells, comprising:
   (a) adding a mixture of detection reporter-labeled nucleic acids isolated from the first and one or more second filamentous fungal cells to a substrate containing an array of *Trichoderma reesei* ESTs or SSH clones, or a combination thereof, selected from the group consisting of SEQ ID NOs. 1-1188, under conditions where the nucleic acids hybridize to complementary sequences of the ESTs or SSH clones, or a combination thereof, in the array, wherein the nucleic acids from the first filamentous fungal cell and the one or more second filamentous fungal cells are labeled with a first detection reporter and one or more different second detection reporters, respectively; and
   (b) examining the array under conditions wherein the relative expression of the genes in the first and one or more second filamentous fungal cells is determined by the observed detection signal of each spot in the array in which (i) the *Trichoderma reesei* ESTs or SSH clones, or a combination thereof, in the array that hybridize to the nucleic acids obtained from either the first or the one or more second filamentous fungal cells produce a distinct first detection signal or one or more second detection signals, respectively, and (ii) the *Trichoderma reesei* ESTs or SSH clones, or a combination thereof, in the array that hybridize to the nucleic acids obtained from both the first and one or more second filamentous fungal cells produce a distinct combined detection signal;
   wherein the hybridization conditions are selected from the group consisting of very low, low, low-medium, medium, medium-high, high, and very high stringency conditions.

2. The method of claim 1, wherein one or more of the first and one or more second filamentous fungal cells are selected from the group consisting of an *Acremonium, Aspergillus, Aureobasidium, Bjerkandera, Ceriporiopsis, Coprinus, Coriolus, Cryptococcus, Filibasidium, Fusarium, Humicola, Magnaporthe, Mucor, Myceliophthora, Neocallimastix, Neurospora, Paediomyces, Penicillium, Phanerochaete, Phlebia, Piromyces, Pleurotus, Schizophyllum, Talaromyces, Thermoascus, Thielavia, Tolypodadium, Trametes,* and *Trichoderma* cell.

3. The method of claim 1, wherein the first and one or more second filamentous fungal cells are the same cell.

4. The method of claim 1, wherein the first and one or more second filamentous fungal cells are *Trichoderma reesei* cells.

5. The method of claim 1, wherein the first and one or more second filamentous fungal cells are different cells.

6. The method of claim 1, wherein the detection reporter is fluorescence.

7. The method of claim 1, wherein the differential expression of a plurality of genes in a first filamentous fungal cell relative to expression of the same genes in one or more second filamentous fungal cells is a result of growth of the first filamentous fungal cell on glucose and growth of the one or more second filamentous fungal cells on a cellulose, hemicellulose, or corn stover source.

8. The method of claim 1, wherein the differential expression of a plurality of genes in a first filamentous fungal cell relative to expression of the same genes in one or more second filamentous fungal cells is a result of one or more different phenotypes.

* * * * *